United States Patent 12,442,020 (MATERIALS AND METHODS FOR TREATMENT OF PAIN RELATED DISORDERS) - sequence listing, part 7

SEQ ID NO: 80261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaacccattcccaccccta

SEQ ID NO: 80262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggccaattagtaacccattc

SEQ ID NO: 80263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattaggccaattagtaac

SEQ ID NO: 80264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacacaacgatgttaaaat

SEQ ID NO: 80265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgacacacaacgatgtta

SEQ ID NO: 80266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttccctgacacacaacgatg

SEQ ID NO: 80267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgttccctgacacacaac

SEQ ID NO: 80268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgttccctgacacacaa

SEQ ID NO: 80269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggcttccctgttccctgac

SEQ ID NO: 80270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaggcttccctgttccct

SEQ ID NO: 80271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcaggcttccctgttccc

SEQ ID NO: 80272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctcaggcttccctgttcc

SEQ ID NO: 80273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctttcctcaggcttccctg

SEQ ID NO: 80274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccctttcctcaggcttccc

SEQ ID NO: 80275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctccctttcctcaggcttc

SEQ ID NO: 80276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctctctccctttcctcagg

SEQ ID NO: 80277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcatccctatctctctccc

SEQ ID NO: 80278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcatccctatctctctcc

SEQ ID NO: 80279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcagcatccctatctctc

SEQ ID NO: 80280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttcagcatccctatctc

SEQ ID NO: 80281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtgacgtgttctgtttc

SEQ ID NO: 80282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaaccacatccacataaga

SEQ ID NO: 80283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggtgctatgaaccacatcc

SEQ ID NO: 80284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggtgctatgaaccacatc

SEQ ID NO: 80285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggggtgctatgaaccacat

SEQ ID NO: 80286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttggggtgctatgaacca

SEQ ID NO: 80287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtaattgttttggggtgc

SEQ ID NO: 80288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtggtaattgttttgggg

SEQ ID NO: 80289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttactgtggtaattgttttg

SEQ ID NO: 80290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttactgtggtaattgtt

SEQ ID NO: 80291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgttactgtggtaattgt

SEQ ID NO: 80292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttgttactgtggtaattg

SEQ ID NO: 80293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatcagtgatctttgttgt

SEQ ID NO: 80294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtgatctatgatcagtga

SEQ ID NO: 80295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatgtgttatggtgatctat

SEQ ID NO: 80296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtatgtgttatggtgatc

SEQ ID NO: 80297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactgtatgtgttatggtg

SEQ ID NO: 80298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attattactgtatgtgttat

SEQ ID NO: 80299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattattactgtatgtgtta

SEQ ID NO: 80300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaattattactgtatgtg

SEQ ID NO: 80301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattatttaattattactg

SEQ ID NO: 80302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattgccattatttaatta

SEQ ID NO: 80303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaattgccattatttaatt

SEQ ID NO: 80304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaattgccattatttaat

SEQ ID NO: 80305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactttgtaattgccattat

SEQ ID NO: 80306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caactttgtaattgccatta

SEQ ID NO: 80307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaatatttcaactttgtaa

SEQ ID NO: 80308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacaatatttcaactttgt

SEQ ID NO: 80309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaattctcacaatatttca

SEQ ID NO: 80310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaattctcacaatatttc

SEQ ID NO: 80311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggcaattctcacaatattt

SEQ ID NO: 80312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcacactttggcaattct

SEQ ID NO: 80313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcatctgtgtcacacttt

SEQ ID NO: 80314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgcatctgtgtcacactt

SEQ ID NO: 80315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttcatgcatctgtgtcac

SEQ ID NO: 80316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacagcatgtgctcacttca

SEQ ID NO: 80317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacagcatgtgctcacttc

SEQ ID NO: 80318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaacagcatgtgctcactt

SEQ ID NO: 80319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaacagcatgtgctcact

SEQ ID NO: 80320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaacagcatgtgctcac

SEQ ID NO: 80321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagcgtaattttttcaaca

SEQ ID NO: 80322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcaagtctgtcagcgtaat

SEQ ID NO: 80323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattaagcaagtctgtcagc

SEQ ID NO: 80324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcaaccctgcattaagca

SEQ ID NO: 80325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggcaaccctgcattaagc

SEQ ID NO: 80326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggtttgtggcaaccctgc

SEQ ID NO: 80327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagttgaaggtttgtggca

SEQ ID NO: 80328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaagttgaaggtttgtggc

SEQ ID NO: 80329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacaagttgaaggtttgtgg

SEQ ID NO: 80330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacaagttgaaggtttgt

SEQ ID NO: 80331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattctttacaagttgaagg

SEQ ID NO: 80332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagatactgcattctttaca

SEQ ID NO: 80333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagatactgcattctttac

SEQ ID NO: 80334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacttcaagatactgcattc

SEQ ID NO: 80335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcacttcaagatactgca

SEQ ID NO: 80336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgcacttcaagatactgc

SEQ ID NO: 80337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattgcacttcaagatactg

SEQ ID NO: 80338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttattgcacttcaagata

SEQ ID NO: 80339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actttattgcacttcaagat

SEQ ID NO: 80340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactttattgcacttcaaga

SEQ ID NO: 80341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggggctttactttattgca

SEQ ID NO: 80342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggggctttactttattgc

SEQ ID NO: 80343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggggctttactttattg

SEQ ID NO: 80344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttatggggctttacttt

SEQ ID NO: 80345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattttatggggctttactt

SEQ ID NO: 80346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcaaaatacaggcatact

SEQ ID NO: 80347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatcaaaatacaggcatac

SEQ ID NO: 80348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttccatcaaaatacaggc

SEQ ID NO: 80349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttccatcaaaatacagg

SEQ ID NO: 80350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtttccatcaaaatacag

SEQ ID NO: 80351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actttggtttccatcaaaat

SEQ ID NO: 80352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctaactttggtttccatc

SEQ ID NO: 80353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcctaactttggtttccat

SEQ ID NO: 80354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcctaactttggtttcca

SEQ ID NO: 80355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacctttatcctaacttt

SEQ ID NO: 80356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaacctttatcctaactt

SEQ ID NO: 80357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaacctttatcctaact

SEQ ID NO: 80358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaaaacctttatcctaa

SEQ ID NO: 80359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattctttaaaaacctttat

SEQ ID NO: 80360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actacattctttaaaaacct

SEQ ID NO: 80361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactacattctttaaaaacc

SEQ ID NO: 80362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactacattctttaaaaac

SEQ ID NO: 80363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcactacattctttaaaaa

SEQ ID NO: 80364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcactacattctttaa

SEQ ID NO: 80365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttttcactacattcttta

SEQ ID NO: 80366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtgtatatgaaatatcc

SEQ ID NO: 80367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatgtgtatatgaaatatc

SEQ ID NO: 80368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatgtgtatatgaaatat

SEQ ID NO: 80369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaatgtgtatatgaaata

SEQ ID NO: 80370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttgaatgtgtatatgaa

SEQ ID NO: 80371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaatcatcctacttttgaa

SEQ ID NO: 80372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaatcatcctacttttga

SEQ ID NO: 80373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagaatcatcctacttttg

SEQ ID NO: 80374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttcagaatcatcctact

SEQ ID NO: 80375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctttcagaatcatcctac

SEQ ID NO: 80376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacctttcagaatcatccta

SEQ ID NO: 80377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttacctttcagaatcatcc

SEQ ID NO: 80378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctttacctttcagaatca

SEQ ID NO: 80379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actctttacctttcagaatc

SEQ ID NO: 80380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccgagtcataacttactctt

SEQ ID NO: 80381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taccaagtagtggaattgcc

SEQ ID NO: 80382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtctgtaccaagtagtgga

SEQ ID NO: 80383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtctgtaccaagtagtgg

SEQ ID NO: 80384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttgagtctgtaccaagta

SEQ ID NO: 80385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattcccttgagtctgtacc

SEQ ID NO: 80386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattcccttgagtctgtac

SEQ ID NO: 80387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattcccttgagtctgta

SEQ ID NO: 80388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtggacatatgttttaaat

SEQ ID NO: 80389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtggacatatgttttaaa

SEQ ID NO: 80390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtgtggacatatgtttta

SEQ ID NO: 80391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtaaacgttcttgtgtgg

SEQ ID NO: 80392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacattcatgtaaacgttct

SEQ ID NO: 80393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgaacattcatgtaaacgt

SEQ ID NO: 80394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtatgaataatgctgctgaa

SEQ ID NO: 80395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctagtatgaataatgctgc

SEQ ID NO: 80396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctagtatgaataatgctg

SEQ ID NO: 80397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctagtatgaataatgct

SEQ ID NO: 80398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggctagtatgaataatgc

SEQ ID NO: 80399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttggctagtatgaataatg

SEQ ID NO: 80400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttttggctagtatgaata

SEQ ID NO: 80401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actttttggctagtatgaat

SEQ ID NO: 80402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttactttttggctagta

SEQ ID NO: 80403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgagtaatgaggttgtgtt

SEQ ID NO: 80404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggtgagtaatgaggttg

SEQ ID NO: 80405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcattggtgagtaatgagg

SEQ ID NO: 80406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcattggtgagtaatgag

SEQ ID NO: 80407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccatttattcattggtgag

SEQ ID NO: 80408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccatttattcattggtga

SEQ ID NO: 80409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatccatttattcattggtg

SEQ ID NO: 80410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttatccatttattcattg

SEQ ID NO: 80411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatcccacattcctttat

SEQ ID NO: 80412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatatcccacattccttta

SEQ ID NO: 80413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtttgaatatcccacat

SEQ ID NO: 80414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcagtgtttgaatatccc

SEQ ID NO: 80415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatactaattcagtgtttga

SEQ ID NO: 80416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaatactaattcagtgtt

SEQ ID NO: 80417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgctaaatactaattcagt

SEQ ID NO: 80418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgctaaatactaattcag

SEQ ID NO: 80419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgctaaatactaattca

SEQ ID NO: 80420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattgctaaatactaattc

SEQ ID NO: 80421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttattgctaaatactaa

SEQ ID NO: 80422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttattgctaaatacta

SEQ ID NO: 80423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttgtttttattgctaaat

SEQ ID NO: 80424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttgtttttattgctaaa

SEQ ID NO: 80425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacttcatttgtttttattg

SEQ ID NO: 80426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacatgtacctatacttca

SEQ ID NO: 80427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcacatccatgttgtaaca

SEQ ID NO: 80428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcacatccatgttgtaac

SEQ ID NO: 80429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatcacatccatgttgtaa

SEQ ID NO: 80430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acggggttttcatcacatcc

SEQ ID NO: 80431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacggggttttcatcacatc

SEQ ID NO: 80432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacggggttttcatcacat

SEQ ID NO: 80433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcacggggttttcatcac

SEQ ID NO: 80434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttctttcacggggttttc

SEQ ID NO: 80435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgttctttcacggggttt

SEQ ID NO: 80436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctctgtgttctttcacggg

SEQ ID NO: 80437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctctgtgttctttcacgg

SEQ ID NO: 80438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctctgtgttctttcacg

SEQ ID NO: 80439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggctctgtgttctttcac

SEQ ID NO: 80440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataagatggaatcatatcgt

SEQ ID NO: 80441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataagatggaatcatatcg

SEQ ID NO: 80442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacatttcataagatggaat

SEQ ID NO: 80443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggacatttcataagatgga

SEQ ID NO: 80444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctggacatttcataagat

SEQ ID NO: 80445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctattctggacatttcata

SEQ ID NO: 80446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctattctggacatttcat

SEQ ID NO: 80447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggatttgcctattctggac

SEQ ID NO: 80448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggggatttgcctattctgg

SEQ ID NO: 80449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggggatttgcctattctg

SEQ ID NO: 80450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctggggatttgcctatt

SEQ ID NO: 80451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttctggggatttgcctat

SEQ ID NO: 80452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttctggggatttgccta

SEQ ID NO: 80453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattttgtttctggggattt

SEQ ID NO: 80454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacattttgtttctggggat

SEQ ID NO: 80455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaaaaaatactctacattt

SEQ ID NO: 80456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgacaaaaaatactctacat

SEQ ID NO: 80457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacccagcctctgacaaaaa

SEQ ID NO: 80458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttacacccagcctctgacaa

SEQ ID NO: 80459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattacacccagcctctga

SEQ ID NO: 80460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctattacacccagcctctg

SEQ ID NO: 80461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accacataaccatcaataat

SEQ ID NO: 80462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accattaaccacataaccat

SEQ ID NO: 80463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccattaaccacataacca

SEQ ID NO: 80464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaccattaaccacataacc

SEQ ID NO: 80465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaccattaaccacataa

SEQ ID NO: 80466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaccccaaaagaagcccca

SEQ ID NO: 80467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaccccaaaagaagcccc

SEQ ID NO: 80468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaccccaaaagaagccc

SEQ ID NO: 80469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcaccccaaaagaagcc

SEQ ID NO: 80470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatatttttatcaccccaa

SEQ ID NO: 80471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatatttttatcacccca

SEQ ID NO: 80472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaatatttttatcacccc

SEQ ID NO: 80473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtagttttagaatattttt

SEQ ID NO: 80474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaaggtatgcaacaatca

SEQ ID NO: 80475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatgttcacaaaggtatgc

SEQ ID NO: 80476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatgttcacaaaggtatg

SEQ ID NO: 80477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtatgttcacaaaggtat

SEQ ID NO: 80478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtatgttcacaaaggta

SEQ ID NO: 80479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtggtttttagtatgttca

SEQ ID NO: 80480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgtatcactcagtggtt

SEQ ID NO: 80481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtgtatcactcagtggt

SEQ ID NO: 80482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagtgtatcactcagtgg

SEQ ID NO: 80483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacaccataaaaaatcacca

SEQ ID NO: 80484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacaccataaaaaatcacc

SEQ ID NO: 80485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatataatttacacaccat

SEQ ID NO: 80486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaagatataatttacacac

SEQ ID NO: 80487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaagatataatttacaca

SEQ ID NO: 80488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattaagatataatttacac

SEQ ID NO: 80489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtagttttattaagata

SEQ ID NO: 80490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcatattcatagtagttt

SEQ ID NO: 80491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgcatattcatagtagtt

SEQ ID NO: 80492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaatgcatattcatagtag

SEQ ID NO: 80493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaattcttaatgcatattc

SEQ ID NO: 80494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggattcaaaattcttaatgc

SEQ ID NO: 80495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggattcaaaattcttaatg

SEQ ID NO: 80496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggattcaaaattcttaat

SEQ ID NO: 80497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatattttaggattcaaaa

SEQ ID NO: 80498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacatattttaggattcaaa

SEQ ID NO: 80499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacatattttaggattcaa

SEQ ID NO: 80500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggacaattttcacatattt

SEQ ID NO: 80501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaggacaattttcacatat

SEQ ID NO: 80502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctgaggacaattttcaca

SEQ ID NO: 80503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattctgaggacaattttc

SEQ ID NO: 80504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctattctgaggacaatttt

SEQ ID NO: 80505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctattctgaggacaatt

SEQ ID NO: 80506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatctcttcctattctgagg

SEQ ID NO: 80507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaatctcttcctattctg

SEQ ID NO: 80508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaaatctcttcctattct

SEQ ID NO: 80509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactaaatctcttcctattc

SEQ ID NO: 80510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactaaatctcttcctatt

SEQ ID NO: 80511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttactaaatctcttcctat

SEQ ID NO: 80512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttttactaaatctcttcc

SEQ ID NO: 80513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttttactaaatctcttc

SEQ ID NO: 80514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcctttttactaaatctc

SEQ ID NO: 80515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcctttttactaaatct

SEQ ID NO: 80516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgtttcctttttactaa

SEQ ID NO: 80517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgatttgtttccttttta

SEQ ID NO: 80518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcattgatttgtttcctt

SEQ ID NO: 80519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattcattgatttgtttcct

SEQ ID NO: 80520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgattcattgatttgtt

SEQ ID NO: 80521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgattcattgatttgt

SEQ ID NO: 80522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatttgattcattgatttg

SEQ ID NO: 80523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttgatttgattcattgat

SEQ ID NO: 80524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaagcacaagtggcaactg

SEQ ID NO: 80525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaatctccaaagcacaag

SEQ ID NO: 80526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaagtgttgaggaatctc

SEQ ID NO: 80527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaagtgttgaggaatct

SEQ ID NO: 80528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatttccaaaagtgttgag

SEQ ID NO: 80529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgatttccaaaagtgttga

SEQ ID NO: 80530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgatttccaaaagtgttg

SEQ ID NO: 80531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acctttatgatttccaaaag

SEQ ID NO: 80532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacctttatgatttccaaa

SEQ ID NO: 80533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcacctttatgatttccaa

SEQ ID NO: 80534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccgtcttctcacctttat

SEQ ID NO: 80535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgaggcaagttatcccgtc

SEQ ID NO: 80536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagtctagtgaggcaagtt

SEQ ID NO: 80537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cactgaaagtctagtgaggc

SEQ ID NO: 80538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagagccacagtatgtctac

SEQ ID NO: 80539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagagccacagtatgtcta

SEQ ID NO: 80540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaagagccacagtatgtc

SEQ ID NO: 80541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcaagagccacagtatgt

SEQ ID NO: 80542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcaagagccacagtatg

SEQ ID NO: 80543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttcaagagccacagtat

SEQ ID NO: 80544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagccaacttttcttcaaga

SEQ ID NO: 80545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaagccaacttttcttca

SEQ ID NO: 80546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaaacaccagttattcaa

SEQ ID NO: 80547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtagaatctacaaaaac

SEQ ID NO: 80548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagttgaatgtagaatctac

SEQ ID NO: 80549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagagatggtaccctccag

SEQ ID NO: 80550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagagatggtaccctcca

SEQ ID NO: 80551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaaagagatggtaccctc

SEQ ID NO: 80552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaaataattcttgaaagag

SEQ ID NO: 80553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcaaataattcttgaaag

SEQ ID NO: 80554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtcaaataattcttgaaa

SEQ ID NO: 80555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatttctgtcaaataattct

SEQ ID NO: 80556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacctagatttctgtcaaat

SEQ ID NO: 80557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacctagatttctgtcaaa

SEQ ID NO: 80558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtacctagatttctgtcaa

SEQ ID NO: 80559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaacatctttgtacctaga

SEQ ID NO: 80560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttcacaacatctttgtac

SEQ ID NO: 80561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaatggacatctgagttca

SEQ ID NO: 80562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagaatcaaactggtaatg

SEQ ID NO: 80563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggggagacagagacagagga

SEQ ID NO: 80564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcatgtgcatgggggttgg

SEQ ID NO: 80565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttgagcatgtgcatgggg

SEQ ID NO: 80566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagctgtgttgagcatgtgc

SEQ ID NO: 80567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggagctgtgttgagcatgt

SEQ ID NO: 80568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcattctggagctgtgttg

SEQ ID NO: 80569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcattctggagctgtgtt

SEQ ID NO: 80570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtcattctggagctgtgt

SEQ ID NO: 80571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatactttagtcattctgg

SEQ ID NO: 80572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatactttagtcattctg

SEQ ID NO: 80573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatactttagtcattct

SEQ ID NO: 80574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatatactttagtcattc

SEQ ID NO: 80575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatatactttagtcatt

SEQ ID NO: 80576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcatatactttagtcat

SEQ ID NO: 80577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttttttcatatactttagt

SEQ ID NO: 80578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcttttttcatatacttta

SEQ ID NO: 80579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctctgcttttttcatatac

SEQ ID NO: 80580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctctgcttttttcatata

SEQ ID NO: 80581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcctctgcttttttcatat

SEQ ID NO: 80582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accaccctttgcctctgctt

SEQ ID NO: 80583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcattgaccaccctttgcct

SEQ ID NO: 80584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatgcatggtaccactag

SEQ ID NO: 80585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcagggaaatattgcccat

SEQ ID NO: 80586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcagggaaatattgccca

SEQ ID NO: 80587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttgatcagggaaatattg

SEQ ID NO: 80588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcttgatcagggaaatatt

SEQ ID NO: 80589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttagcttgatcagggaaa

SEQ ID NO: 80590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttagcttgatcagggaa

SEQ ID NO: 80591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatttagcttgatcaggga

SEQ ID NO: 80592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttaatttagcttgatcag

SEQ ID NO: 80593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttaatttagcttgatca

SEQ ID NO: 80594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtcttcctttaatttagc

SEQ ID NO: 80595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtgtcttcctttaatttag

SEQ ID NO: 80596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcaggtgcttagtgtcttc

SEQ ID NO: 80597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagatcatgatgttaagca

SEQ ID NO: 80598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagatcatgatgttaagc

SEQ ID NO: 80599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttcacagatcatgatgt

SEQ ID NO: 80600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatttcacagatcatgatg

SEQ ID NO: 80601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttccatttcacagatca

SEQ ID NO: 80602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacttccatttcacagatc

SEQ ID NO: 80603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcaacttccatttcacaga

SEQ ID NO: 80604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcaaggtctcttcaacttc

SEQ ID NO: 80605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggatgatgatgaaatctg

SEQ ID NO: 80606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaactagaggatgatgatg

SEQ ID NO: 80607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccaaactagaggatgatga

SEQ ID NO: 80608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctctccaaactagaggat

SEQ ID NO: 80609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctctccaaactagagga

SEQ ID NO: 80610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaaatgaaaggaagtttc

SEQ ID NO: 80611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaattagtaaaatgaaag

SEQ ID NO: 80612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagctataaaattagtaaa

SEQ ID NO: 80613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagctataaaattagtaa

SEQ ID NO: 80614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaaagctataaaattagt

SEQ ID NO: 80615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcaaagctataaaattag

SEQ ID NO: 80616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttcaaagctataaaatt

SEQ ID NO: 80617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcttcttcaaagctataaa

SEQ ID NO: 80618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagctgctcttcttcaaagc

SEQ ID NO: 80619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatgccaactaaagctgct

SEQ ID NO: 80620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagcaaactcagatgccaa

SEQ ID NO: 80621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaagcaaactcagatgcca

SEQ ID NO: 80622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtacaataacttccaagcaa

SEQ ID NO: 80623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctggtacaataacttcca

SEQ ID NO: 80624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaccccactggcctggtac

SEQ ID NO: 80625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaccccactggcctggta

SEQ ID NO: 80626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcatcttgccaccccactgg

SEQ ID NO: 80627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagcctatcatcttgccac

SEQ ID NO: 80628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaccctgtcagcctatcat

SEQ ID NO: 80629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtaaccctgtcagcctatc

SEQ ID NO: 80630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccctctgtaaccctgtcagc

SEQ ID NO: 80631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttgccctctgtaaccctg

SEQ ID NO: 80632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgttgccctctgtaaccct

SEQ ID NO: 80633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttatgttgccctctgtaac

SEQ ID NO: 80634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttatgttgccctctgtaa

SEQ ID NO: 80635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttatgttgccctctgta

SEQ ID NO: 80636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacttatgttgccctctgt

SEQ ID NO: 80637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catttttacttatgttgccc

SEQ ID NO: 80638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgaagtgtgaggctccatt

SEQ ID NO: 80639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgtgttggtgaagtgtga

SEQ ID NO: 80640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtgtgttggtgaagtgtg

SEQ ID NO: 80641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtgtgttggtgaagtgt

SEQ ID NO: 80642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtgtgtgttggtgaagt

SEQ ID NO: 80643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttgtgtgtgttggtgaag

SEQ ID NO: 80644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catcttctttgtgtgtgttg

SEQ ID NO: 80645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccccatcattgcatcttctt

SEQ ID NO: 80646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtcacacataggtcctgc

SEQ ID NO: 80647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agggaagaggaaagaagttg

SEQ ID NO: 80648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccagaagactaagggaaga

SEQ ID NO: 80649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccagaagactaagggaag

SEQ ID NO: 80650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatccagaagactaaggg

SEQ ID NO: 80651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggcctgtttatccagaaga

SEQ ID NO: 80652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtggcctgtttatccaga

SEQ ID NO: 80653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaaaactcctgtggcctg

SEQ ID NO: 80654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actaatgaaaactcctgtgg

SEQ ID NO: 80655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgcctgactaatgaaaac

SEQ ID NO: 80656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactaaatgcctgactaatg

SEQ ID NO: 80657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaactaaatgcctgactaat

SEQ ID NO: 80658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatcttaaactaaatgcct

SEQ ID NO: 80659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccagaaatctcaaatctt

SEQ ID NO: 80660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccaccagaaatctcaaat

SEQ ID NO: 80661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actccaccagaaatctcaaa

SEQ ID NO: 80662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatttactccaccagaaa

SEQ ID NO: 80663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatttactccaccagaa

SEQ ID NO: 80664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttaaatatttactccac

SEQ ID NO: 80665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttaaatatttactcca

SEQ ID NO: 80666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatttaaatatttactcc

SEQ ID NO: 80667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccatttaaatatttactc

SEQ ID NO: 80668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttccatttaaatattta

SEQ ID NO: 80669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttccatttaaatattt

SEQ ID NO: 80670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttttccatttaaatatt

SEQ ID NO: 80671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctttatttttccatttaa

SEQ ID NO: 80672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagctttatttttccattta

SEQ ID NO: 80673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatgtttgagctttatttt

SEQ ID NO: 80674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagaatgtttgagctttat

SEQ ID NO: 80675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attagaatgtttgagcttta

SEQ ID NO: 80676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattagaatgtttgagcttt

SEQ ID NO: 80677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattagaatgtttgagctt

SEQ ID NO: 80678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttattagaatgtttga

SEQ ID NO: 80679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttttattagaatgtttg

SEQ ID NO: 80680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacttttattagaatgttt

SEQ ID NO: 80681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttcacttttattagaat

SEQ ID NO: 80682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataagtattcattttcact

SEQ ID NO: 80683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acattaaataagtattcatt

SEQ ID NO: 80684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcacattaaataagtattca

SEQ ID NO: 80685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctcacattaaataagtat

SEQ ID NO: 80686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactctcacattaaataagt

SEQ ID NO: 80687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctactctcacattaaataa

SEQ ID NO: 80688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtcctctctactctcac

SEQ ID NO: 80689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaagtcctctctactctca

SEQ ID NO: 80690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacaagtcctctctactctc

SEQ ID NO: 80691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtaatgctttacaagtcc

SEQ ID NO: 80692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgtaatgctttacaagtc

SEQ ID NO: 80693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtgtaatgctttacaagt

SEQ ID NO: 80694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctttggtgtaatgctttac

SEQ ID NO: 80695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctttggtgtaatgcttta

SEQ ID NO: 80696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcctttggtgtaatgcttt

SEQ ID NO: 80697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gattttgcctttggtgtaat

SEQ ID NO: 80698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgattttgcctttggtgtaa

SEQ ID NO: 80699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgattttgcctttggtgta

SEQ ID NO: 80700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcgattttgcctttggtgt

SEQ ID NO: 80701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcgattttgcctttggtg

SEQ ID NO: 80702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttttcgattttgccttt

SEQ ID NO: 80703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctttttcgattttgcctt

SEQ ID NO: 80704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctttttcgattttgcct

SEQ ID NO: 80705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttatctttttcgattttgc

SEQ ID NO: 80706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcattctttatctttttcga

SEQ ID NO: 80707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctagcattctttatctt

SEQ ID NO: 80708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagattaaatctagcattc

SEQ ID NO: 80709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatgagattaaatctagca

SEQ ID NO: 80710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgttatgagattaaatct

SEQ ID NO: 80711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgttatgagattaaatc

SEQ ID NO: 80712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaccttcattgttatgag

SEQ ID NO: 80713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaccttcattgttatga

SEQ ID NO: 80714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaccttcattgttatg

SEQ ID NO: 80715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaaaccttcattgttat

SEQ ID NO: 80716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacttttaaaaaccttcatt

SEQ ID NO: 80717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacttttaaaaaccttcat

SEQ ID NO: 80718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggatgccttccacttttaa

SEQ ID NO: 80719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggatgccttccactttta

SEQ ID NO: 80720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggatgccttccactttt

SEQ ID NO: 80721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtggatgccttccact

SEQ ID NO: 80722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgtggatgccttccac

SEQ ID NO: 80723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttgtggatgccttcca

SEQ ID NO: 80724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttgtggatgccttcc

SEQ ID NO: 80725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttgtggatgccttc

SEQ ID NO: 80726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttattttgtggatgcctt

SEQ ID NO: 80727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttattttgtggatgcct

SEQ ID NO: 80728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactttttttattttgtgga

SEQ ID NO: 80729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattgtactttttttatttt

SEQ ID NO: 80730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattgtactttttttattt

SEQ ID NO: 80731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatttgtattgtacttttt

SEQ ID NO: 80732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctgtcatttgtattgtac

SEQ ID NO: 80733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catctgtcatttgtattgta

SEQ ID NO: 80734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggaaaagcacttcatctg

SEQ ID NO: 80735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaaaggaaaagcacttca

SEQ ID NO: 80736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcattaaaggaaaagcact

SEQ ID NO: 80737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcattaaaggaaaagcac

SEQ ID NO: 80738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattcattaaaggaaaagca

SEQ ID NO: 80739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatctttattcattaaagg

SEQ ID NO: 80740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagatatattaatatcttt

SEQ ID NO: 80741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgagatatattaatatctt

SEQ ID NO: 80742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgagatatattaatatct

SEQ ID NO: 80743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattttatgagatatattaa

SEQ ID NO: 80744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaattttatgagatatat

SEQ ID NO: 80745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaaattttatgagatata

SEQ ID NO: 80746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactaaattttatgagatat

SEQ ID NO: 80747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactaaattttatgagata

SEQ ID NO: 80748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactaaattttatgagat

SEQ ID NO: 80749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttttttactaaattttat

SEQ ID NO: 80750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataattatgttttttacta

SEQ ID NO: 80751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agataattatgttttttact

SEQ ID NO: 80752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagataattatgttttttac

SEQ ID NO: 80753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagataattatgtttttta

SEQ ID NO: 80754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagataattatgtt

SEQ ID NO: 80755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagataattatgt

SEQ ID NO: 80756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatttgtatttttagata

SEQ ID NO: 80757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaccatttgtatttttag

SEQ ID NO: 80758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaccatttgtattttta

SEQ ID NO: 80759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtgtttattaaccattt

SEQ ID NO: 80760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatggttacaagtgtttat

SEQ ID NO: 80761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacatggttacaagtgttta

SEQ ID NO: 80762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgaggtttgacatggttac

SEQ ID NO: 80763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagtgaggtttgacatggt

SEQ ID NO: 80764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attactagtgaggtttgaca

SEQ ID NO: 80765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattactagtgaggtttgac

SEQ ID NO: 80766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgattactagtgaggtttga

SEQ ID NO: 80767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgattactagtgaggttt

SEQ ID NO: 80768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgattactagtgaggtt

SEQ ID NO: 80769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctttgattactagtgag

SEQ ID NO: 80770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttctttgattactagtga

SEQ ID NO: 80771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatttgtttctttgattac

SEQ ID NO: 80772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatttgtttctttgatta

SEQ ID NO: 80773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatatttgtttctttgatt

SEQ ID NO: 80774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaatatttgtttctttg

SEQ ID NO: 80775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttaatatttgtttcttt

SEQ ID NO: 80776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccatgtttattttaatatt

SEQ ID NO: 80777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccccatgtttattttaa

SEQ ID NO: 80778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttccccatgtttatttta

SEQ ID NO: 80779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataggccaaatttggttccc

SEQ ID NO: 80780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgattaataggccaaattt

SEQ ID NO: 80781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaatgattaataggccaaa

SEQ ID NO: 80782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaatgattaataggccaa

SEQ ID NO: 80783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctaatgattaataggcca

SEQ ID NO: 80784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatctttgctaatgattaa

SEQ ID NO: 80785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaaatctttgctaatgat

SEQ ID NO: 80786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaaatctttgctaatga

SEQ ID NO: 80787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaaaatctttgctaatg

SEQ ID NO: 80788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttaaaatctttgctaat

SEQ ID NO: 80789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttgttaaaatctttgct

SEQ ID NO: 80790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttacttttgttaaaatcttt

SEQ ID NO: 80791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatcactattacttttgtt

SEQ ID NO: 80792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatatcactattacttttg

SEQ ID NO: 80793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctaatatcactattacttt

SEQ ID NO: 80794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taacctctctaatatcacta

SEQ ID NO: 80795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctataacctctctaatat

SEQ ID NO: 80796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccctataacctctctaata

SEQ ID NO: 80797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttcccctataacctctct

SEQ ID NO: 80798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccagacaggcaacactga

SEQ ID NO: 80799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catccagacaggcaacactg

SEQ ID NO: 80800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatccagacaggcaacact

SEQ ID NO: 80801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttcatccagacaggcaac

SEQ ID NO: 80802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactttcatccagacaggc

SEQ ID NO: 80803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactttcatccagacagg

SEQ ID NO: 80804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattactttcatccagac

SEQ ID NO: 80805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggcgtgagccaccgcacc

SEQ ID NO: 80806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattataggcgtgagccac

SEQ ID NO: 80807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggattataggcgtgagcc

SEQ ID NO: 80808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagttctgggattatag

SEQ ID NO: 80809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcctcccaaagttctggga

SEQ ID NO: 80810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgggcctcccaaagttct

SEQ ID NO: 80811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgcctgggcctcccaaag

SEQ ID NO: 80812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgatctgcctgcctgggcc

SEQ ID NO: 80813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcatgatctgcctgcct

SEQ ID NO: 80814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctcatgatctgcctg

SEQ ID NO: 80815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gatctcctgacctcatgatc

SEQ ID NO: 80816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtctcgatctcctgacctca

SEQ ID NO: 80817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gccaggttggtctcgatctc

SEQ ID NO: 80818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagtgttcgccaggttggt

SEQ ID NO: 80819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagtgttcgccaggttgg

SEQ ID NO: 80820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacagggtttcacag

SEQ ID NO: 80821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacagggtttcaca

SEQ ID NO: 80822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacagggtttcac

SEQ ID NO: 80823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagtagagacagggtttca

SEQ ID NO: 80824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttttagtagagacaggg

SEQ ID NO: 80825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacttttagtagagacagg

SEQ ID NO: 80826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacttttagtagagacag

SEQ ID NO: 80827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtacttttagtagagaca

SEQ ID NO: 80828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtacttttagtagagac

SEQ ID NO: 80829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtacttttagtagaga

SEQ ID NO: 80830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttttgtacttttagta

SEQ ID NO: 80831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaatttttttgtactttt

SEQ ID NO: 80832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaacatgcctggctaattt

SEQ ID NO: 80833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggcgcctgccaacatgcc

SEQ ID NO: 80834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggactataggcgcctgccaa

SEQ ID NO: 80835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgagcagctgggactatag

SEQ ID NO: 80836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcccgagcagctggga

SEQ ID NO: 80837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcccgagcagct

SEQ ID NO: 80838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcctcagcctcccgagcag

SEQ ID NO: 80839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgcctcagcctcccgagc

SEQ ID NO: 80840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgccattctctgcctcagc

SEQ ID NO: 80841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttcacgccattctctgcc

SEQ ID NO: 80842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgggttcacgccattctct

SEQ ID NO: 80843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgcctcctgggttcacgcca

SEQ ID NO: 80844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagctccgcctcctgggtt

SEQ ID NO: 80845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaagctccgcctcctg

SEQ ID NO: 80846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcactgcaagctccgcct

SEQ ID NO: 80847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcactgcaagctccgcc

SEQ ID NO: 80848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtggcacgatctt

SEQ ID NO: 80849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcagtgg

SEQ ID NO: 80850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcccaggctggagtgcag

SEQ ID NO: 80851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattgcccaggctggagtgc

SEQ ID NO: 80852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gctctattgcccaggctgga

SEQ ID NO: 80853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacggagtctcgctctatt

SEQ ID NO: 80854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacggagtctcgctctat

SEQ ID NO: 80855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgagacggagtctcgctc

SEQ ID NO: 80856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgagacggagtctcgct

SEQ ID NO: 80857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttgagacggagtctc

SEQ ID NO: 80858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttgagacggagtct

SEQ ID NO: 80859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttatttgagacggag

SEQ ID NO: 80860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttatttgagacgga

SEQ ID NO: 80861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttatttatttgagacgg

SEQ ID NO: 80862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacactttatttatttattt

SEQ ID NO: 80863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacactttatttatttatt

SEQ ID NO: 80864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaagtttgtacactttat

SEQ ID NO: 80865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctcaaaaagtttgtacac

SEQ ID NO: 80866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaattaccctcaaaaagt

SEQ ID NO: 80867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagatattacaaaattacc

SEQ ID NO: 80868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatagatattacaaaattac

SEQ ID NO: 80869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatagatattacaaaatta

SEQ ID NO: 80870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgatagatattacaaaatt

SEQ ID NO: 80871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcttttgatagatattac

SEQ ID NO: 80872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggcttttgatagatatta

SEQ ID NO: 80873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgtgtttaaggcttttgat

SEQ ID NO: 80874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaatataaacgaattcacg

SEQ ID NO: 80875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaatataaacgaattcac

SEQ ID NO: 80876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttggcaatataaacgaatt

SEQ ID NO: 80877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaggaaaattatttggcaa

SEQ ID NO: 80878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagaaggaaaattatttgg

SEQ ID NO: 80879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataaattcctagaaggaaa

SEQ ID NO: 80880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataaattcctagaaggaa

SEQ ID NO: 80881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaataaattcctagaagga

SEQ ID NO: 80882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctttgaataaattcctaga

SEQ ID NO: 80883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtctttgaataaattcct

SEQ ID NO: 80884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agattactgtctttgaataa

SEQ ID NO: 80885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggacacctgagattactg

SEQ ID NO: 80886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatgttagaggacacctg

SEQ ID NO: 80887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacatgttagaggacacct

SEQ ID NO: 80888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtaaatatatttatacat

SEQ ID NO: 80889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaatattgtagtaaata

SEQ ID NO: 80890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatattataaaaatattgta

SEQ ID NO: 80891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatattataaaaatattgt

SEQ ID NO: 80892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatattataaaaatattg

SEQ ID NO: 80893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaatattataaaaatatt

SEQ ID NO: 80894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatttttcaatattataaa

SEQ ID NO: 80895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attataatttttcaatatta

SEQ ID NO: 80896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattgattataatttttcaa

SEQ ID NO: 80897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggattgattataatttttca

SEQ ID NO: 80898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggattgattataatttttc

SEQ ID NO: 80899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggattttggattgattataa

SEQ ID NO: 80900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaggattttggattgatta

SEQ ID NO: 80901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgttaggattttggattga

SEQ ID NO: 80902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgttaggattttggattg

SEQ ID NO: 80903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtaacccttactgttagg

SEQ ID NO: 80904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtaacccttactgttag

SEQ ID NO: 80905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttagtgtaacccttactg

SEQ ID NO: 80906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttagtgtaacccttact

SEQ ID NO: 80907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcatttagtgtaaccctt

SEQ ID NO: 80908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attacttcatttagtgtaac

SEQ ID NO: 80909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacattcattacttcattta

SEQ ID NO: 80910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatacattcattacttca

SEQ ID NO: 80911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattatacattcattacttc

SEQ ID NO: 80912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcattatacattcattac

SEQ ID NO: 80913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attatttcattatacattca

SEQ ID NO: 80914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcattatttcattatacat

SEQ ID NO: 80915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagctgctcattatttcat

SEQ ID NO: 80916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaagctgctcattatttca

SEQ ID NO: 80917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaagctgctcattatttc

SEQ ID NO: 80918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcaaagctgctcattatt

SEQ ID NO: 80919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttcaaagctgctcatta

SEQ ID NO: 80920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacgctctctttcaaagctg

SEQ ID NO: 80921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacgctctctttcaaagct

SEQ ID NO: 80922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaacgctctctttcaaagc

SEQ ID NO: 80923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagtctttgaacgctctc

SEQ ID NO: 80924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaaatagtctttgaacgc

SEQ ID NO: 80925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcattaaatagtctttga

SEQ ID NO: 80926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattcattaaatagtctttg

SEQ ID NO: 80927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttaattcattaaatagtc

SEQ ID NO: 80928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattcatttaattcattaa

SEQ ID NO: 80929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattcatttaattcatta

SEQ ID NO: 80930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataattcatttaattcatt

SEQ ID NO: 80931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataattcatttaattcat

SEQ ID NO: 80932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttttataattcatttaa

SEQ ID NO: 80933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcattatatttttataatt

SEQ ID NO: 80934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgcattatatttttata

SEQ ID NO: 80935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attatgcattatatttttat

SEQ ID NO: 80936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacttattatgcattatatt

SEQ ID NO: 80937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattccacttattatgcatt

SEQ ID NO: 80938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtataacctggattcca

SEQ ID NO: 80939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctgtgtgtataacctggat

SEQ ID NO: 80940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctatctgtgtgtataac

SEQ ID NO: 80941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatctatctgtgtgtataa

SEQ ID NO: 80942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttacatctatctgtgtgt

SEQ ID NO: 80943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatttacatctatctgtg

SEQ ID NO: 80944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattaatttacatctatct

SEQ ID NO: 80945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaattattattaatttaca

SEQ ID NO: 80946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaattattattaatttac

SEQ ID NO: 80947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaattattattaattta

SEQ ID NO: 80948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatcattttaaaaattat

SEQ ID NO: 80949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaatatcattttaaaa

SEQ ID NO: 80950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattaaatatcattttaaa

SEQ ID NO: 80951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtatttaaattaaatatca

SEQ ID NO: 80952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgcattgtgtatttaaat

SEQ ID NO: 80953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaatgcattgtgtattta

SEQ ID NO: 80954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaatgcattgtgtattt

SEQ ID NO: 80955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttaaatgcattgtgtatt

SEQ ID NO: 80956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactttgttaaatgcattgt

SEQ ID NO: 80957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggctaaactttgttaaatg

SEQ ID NO: 80958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actagggctaaactttgtta

SEQ ID NO: 80959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactagggctaaactttgtt

SEQ ID NO: 80960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaactagggctaaactttg

SEQ ID NO: 80961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagtaaagtataaagaca

SEQ ID NO: 80962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaagtaaagtataaagac

SEQ ID NO: 80963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacaaatttgaaaagtaaag

SEQ ID NO: 80964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttgtacaaatttgaaaagt

SEQ ID NO: 80965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgttgtacaaatttgaaaag

SEQ ID NO: 80966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgttgtacaaatttgaaaa

SEQ ID NO: 80967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatagaaaaacatgacattt

SEQ ID NO: 80968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggatagaaaaacatgacat

SEQ ID NO: 80969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggatagaaaaacatgaca

SEQ ID NO: 80970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctggatagaaaaacatga

SEQ ID NO: 80971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctggatagaaaaacatg

SEQ ID NO: 80972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttctggatagaaaaacat

SEQ ID NO: 80973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcttctggatagaaaaac

SEQ ID NO: 80974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcttctggatagaaaaa

SEQ ID NO: 80975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttcttctggatagaaaa

SEQ ID NO: 80976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagtatattttctttcttc

SEQ ID NO: 80977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaagtatattttctttctt

SEQ ID NO: 80978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaagtatattttctttct

SEQ ID NO: 80979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaagtatattttctttc

SEQ ID NO: 80980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaaagtatattttcttt

SEQ ID NO: 80981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcaaagtatattttctt

SEQ ID NO: 80982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgatttttttcaaagtat

SEQ ID NO: 80983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgatttttttcaaagta

SEQ ID NO: 80984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgatttttttcaaagt

SEQ ID NO: 80985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcaaataattttaaatga

SEQ ID NO: 80986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataaaattaggtcaaataa

SEQ ID NO: 80987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actatataaaattaggtcaa

SEQ ID NO: 80988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgactatataaaattagg

SEQ ID NO: 80989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgactatataaaattag

SEQ ID NO: 80990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttcattgactatataaaa

SEQ ID NO: 80991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgatttcattgactatat

SEQ ID NO: 80992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacatgacaagaataaatat

SEQ ID NO: 80993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaattaaacatgacaagaa

SEQ ID NO: 80994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaattgtaaattaaacatg

SEQ ID NO: 80995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaattgtaaattaaacat

SEQ ID NO: 80996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaattgtaaattaaaca

SEQ ID NO: 80997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaaattgtaaattaaac

SEQ ID NO: 80998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaagtggaaatgtagca

SEQ ID NO: 80999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagaagatacaatcatagta

SEQ ID NO: 81000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagaagatacaatcatag

SEQ ID NO: 81001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctaaagaagatacaatc

SEQ ID NO: 81002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattctaaagaagatacaat

SEQ ID NO: 81003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatttcattctaaagaaga

SEQ ID NO: 81004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgcaacattgggatttca

SEQ ID NO: 81005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgcaacattgggatttc

SEQ ID NO: 81006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatgcaacattgggattt

SEQ ID NO: 81007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctttatatgcaacattggg

SEQ ID NO: 81008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggtgagtgggtaagatag

SEQ ID NO: 81009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatgagattaatggtgagt

SEQ ID NO: 81010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatatgagattaatggtga

SEQ ID NO: 81011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaatatgagattaatggt

SEQ ID NO: 81012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtattctctaatatgagat

SEQ ID NO: 81013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaagtattctctaatatg

SEQ ID NO: 81014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagttgcctaagtattctc

SEQ ID NO: 81015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagttgcctaagtattct

SEQ ID NO: 81016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagttgcctaagtattc

SEQ ID NO: 81017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttagtagttgcctaagt

SEQ ID NO: 81018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttagtagttgcctaag

SEQ ID NO: 81019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattttagtagttgcctaa

SEQ ID NO: 81020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattttagtagttgccta

SEQ ID NO: 81021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaattttagtagttgcct

SEQ ID NO: 81022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttttaattttagtagtt

SEQ ID NO: 81023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatacaagaataacacattc

SEQ ID NO: 81024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agatacaagaataacacatt

SEQ ID NO: 81025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggaaatcttagatacaag

SEQ ID NO: 81026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actataggaaatcttagata

SEQ ID NO: 81027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactataggaaatcttagat

SEQ ID NO: 81028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactataggaaatcttaga

SEQ ID NO: 81029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttaactataggaaatct

SEQ ID NO: 81030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catattgattttaactatag

SEQ ID NO: 81031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatattgattttaactata

SEQ ID NO: 81032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaataaatatttccatatt

SEQ ID NO: 81033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catacatagaaaataagaaa

SEQ ID NO: 81034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatatgtgtgtgtctgca

SEQ ID NO: 81035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacagacatagatccataga

SEQ ID NO: 81036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacagacatagatccatag

SEQ ID NO: 81037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatagacaaatacatgatat

SEQ ID NO: 81038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaagatgtgtgaagaaaaa

SEQ ID NO: 81039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actggaaagatgtgtgaaga

SEQ ID NO: 81040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactggaaagatgtgtgaag

SEQ ID NO: 81041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgactggaaagatgtgtgaa

SEQ ID NO: 81042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgactggaaagatgtgt

SEQ ID NO: 81043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acattgctttgactggaaag

SEQ ID NO: 81044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggagctgacattgctttgac

SEQ ID NO: 81045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaactgggagctgacatt

SEQ ID NO: 81046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgaactgggagctgacat

SEQ ID NO: 81047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgaactgggagctgaca

SEQ ID NO: 81048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggccagagagtgtgataa

SEQ ID NO: 81049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaggccagagagtgtgata

SEQ ID NO: 81050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatggaaatttgaaggcca

SEQ ID NO: 81051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcaatggaaatttgaagg

SEQ ID NO: 81052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgcaatggaaatttgaag

SEQ ID NO: 81053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgcaatggaaatttgaa

SEQ ID NO: 81054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgcaatggaaatttga

SEQ ID NO: 81055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttactgcaatggaaatt

SEQ ID NO: 81056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttactgcaatggaaat

SEQ ID NO: 81057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttttactgcaatggaaa

SEQ ID NO: 81058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacatctttgtttttactgc

SEQ ID NO: 81059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gccactgtacatctttgttt

SEQ ID NO: 81060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgccactgtacatctttgtt

SEQ ID NO: 81061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatttcgccactgtacatc

SEQ ID NO: 81062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaacatttcgccactgta

SEQ ID NO: 81063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgatattatctaacatttc

SEQ ID NO: 81064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgatattatctaacattt

SEQ ID NO: 81065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgatattatctaacatt

SEQ ID NO: 81066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtgatattatctaacat

SEQ ID NO: 81067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttttagtgatattatcta

SEQ ID NO: 81068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtttttagtgatattatc

SEQ ID NO: 81069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctggtttttagtgatatt

SEQ ID NO: 81070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctctggtttttagtgatat

SEQ ID NO: 81071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttcctctggtttttagtg

SEQ ID NO: 81072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttcctctggtttttagt

SEQ ID NO: 81073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttcctctggtttttag

SEQ ID NO: 81074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtcttcctctggttttta

SEQ ID NO: 81075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtcttcctctggttttt

SEQ ID NO: 81076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtcttcctctggtttt

SEQ ID NO: 81077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttgtcttcctctggttt

SEQ ID NO: 81078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgataactttttttgtcttc

SEQ ID NO: 81079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgataactttttttgtctt

SEQ ID NO: 81080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatttatgataactttttt

SEQ ID NO: 81081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgatttatgataacttttt

SEQ ID NO: 81082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtaatcttatgatttatg

SEQ ID NO: 81083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actagggtaatcttatgatt

SEQ ID NO: 81084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcactagggtaatcttatg

SEQ ID NO: 81085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctcctcactagggtaatc

SEQ ID NO: 81086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatctcctcactagggtaat

SEQ ID NO: 81087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatctcctcactagggtaa

SEQ ID NO: 81088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttgatctcctcactaggg

SEQ ID NO: 81089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctttgatctcctcactag

SEQ ID NO: 81090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgctttgatctcctcacta

SEQ ID NO: 81091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagcttctgctttgatctcc

SEQ ID NO: 81092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactgtagcttctgctttga

SEQ ID NO: 81093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagactgtagcttctgcttt

SEQ ID NO: 81094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatgagtgttctagactgt

SEQ ID NO: 81095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagatgagtgttctagact

SEQ ID NO: 81096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acattctcagatgagtgttc

SEQ ID NO: 81097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacattctcagatgagtgt

SEQ ID NO: 81098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaagaaattctaacattct

SEQ ID NO: 81099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctagaaagaaattctaacat

SEQ ID NO: 81100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctagaaagaaattctaac

SEQ ID NO: 81101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgctagaaagaaattcta

SEQ ID NO: 81102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgctagaaagaaattct

SEQ ID NO: 81103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgacttctctgctagaaaga

SEQ ID NO: 81104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatagaaatctgtgacttc

SEQ ID NO: 81105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccatagaaatctgtgactt

SEQ ID NO: 81106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catcacatatttgccataga

SEQ ID NO: 81107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctacatcacatatttgcc

SEQ ID NO: 81108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatctacatcacatatttg

SEQ ID NO: 81109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatctacatcacatattt

SEQ ID NO: 81110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgatctacatcacatatt

SEQ ID NO: 81111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctgatctacatcacat

SEQ ID NO: 81112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttctgatctacatcaca

SEQ ID NO: 81113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaacttgttttctgatct

SEQ ID NO: 81114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataaataatccatggatta

SEQ ID NO: 81115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaataaataatccatgga

SEQ ID NO: 81116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacattattgaataaataa

SEQ ID NO: 81117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaacattattgaataaat

SEQ ID NO: 81118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcaacattattgaataaa

SEQ ID NO: 81119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcaacattattgaataa

SEQ ID NO: 81120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatagagagggaagtggga

SEQ ID NO: 81121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatagagagggaagtggg

SEQ ID NO: 81122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catatttaacatagagaggg

SEQ ID NO: 81123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacatatttaacatagaga

SEQ ID NO: 81124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctacatatttaacataga

SEQ ID NO: 81125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagataaaccactctgctac

SEQ ID NO: 81126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagataaaccactctgcta

SEQ ID NO: 81127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgatagcttggagataaac

SEQ ID NO: 81128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgatagcttggagataaa

SEQ ID NO: 81129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgatagcttggagataa

SEQ ID NO: 81130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggtgatagcttggagata

SEQ ID NO: 81131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccttttggtgatagcttgg

SEQ ID NO: 81132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcagatattatccttttg

SEQ ID NO: 81133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaatgcagatattatcct

SEQ ID NO: 81134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattaatgcagatattatcc

SEQ ID NO: 81135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttaattaatgcagatatt

SEQ ID NO: 81136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggagtcctaccttaattaat

SEQ ID NO: 81137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatggacatggatacccta

SEQ ID NO: 81138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctaaaatggacatggatac

SEQ ID NO: 81139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagctaaaatggacatggat

SEQ ID NO: 81140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttctagctaaaatggacat

SEQ ID NO: 81141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccctggttctagctaaaa

SEQ ID NO: 81142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gactccaccctggttctagc

SEQ ID NO: 81143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcgactccaccctggttc

SEQ ID NO: 81144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctcgactccaccctggtt

SEQ ID NO: 81145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctcgactccaccctggt

SEQ ID NO: 81146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatgtatggatgaggagta

SEQ ID NO: 81147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggatgtatggatgaggagt

SEQ ID NO: 81148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggatgtatggatgaggag

SEQ ID NO: 81149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattttaggatgtatggatg

SEQ ID NO: 81150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaggcaggctacattttag

SEQ ID NO: 81151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtatatacatgtatggtgt

SEQ ID NO: 81152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaggtctgtgtatatacat

SEQ ID NO: 81153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagagagggatgactgaaa

SEQ ID NO: 81154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagagagggatgactgaa

SEQ ID NO: 81155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgaaagagagggatgactg

SEQ ID NO: 81156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgaaagagagggatgac

SEQ ID NO: 81157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagacaaatcctctcttga

SEQ ID NO: 81158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagacaaatcctctcttg

SEQ ID NO: 81159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcccagacaaatcctctc

SEQ ID NO: 81160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaggtctgtttcccagac

SEQ ID NO: 81161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacaggtctgtttcccaga

SEQ ID NO: 81162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatacaggtctgtttcccag

SEQ ID NO: 81163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctttatacaggtctgtttc

SEQ ID NO: 81164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catctgtctttatacaggtc

SEQ ID NO: 81165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatctgtctttatacaggt

SEQ ID NO: 81166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaggtttgcatctgtctt

SEQ ID NO: 81167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgttggccaggtttgcatc

SEQ ID NO: 81168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaagaaaggccaggttgg

SEQ ID NO: 81169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggaagaaaggccaggttg

SEQ ID NO: 81170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatttatggaagaaaggcc

SEQ ID NO: 81171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatatttatggaagaaag

SEQ ID NO: 81172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatctattaatatttatg

SEQ ID NO: 81173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gataatctattaatatttat

SEQ ID NO: 81174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgataatctattaatattt

SEQ ID NO: 81175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttgataatctattaata

SEQ ID NO: 81176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttgataatctattaat

SEQ ID NO: 81177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaatttattcttgataatc

SEQ ID NO: 81178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaccaatttattcttgat

SEQ ID NO: 81179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattaccaatttattcttga

SEQ ID NO: 81180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagatcttcattaccaatt

SEQ ID NO: 81181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtagatcttcattaccaat

SEQ ID NO: 81182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttggtagatcttcatta

SEQ ID NO: 81183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtttggtagatcttcatt

SEQ ID NO: 81184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtttggtagatcttcat

SEQ ID NO: 81185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttatgtttggtagatc

SEQ ID NO: 81186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttatgtttggtagat

SEQ ID NO: 81187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaattttatgtttggtaga

SEQ ID NO: 81188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctttcaattttatgtttg

SEQ ID NO: 81189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtctttcaattttatgttt

SEQ ID NO: 81190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttagtctttcaatttta

SEQ ID NO: 81191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatcttagtctttcaatt

SEQ ID NO: 81192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtctgttcatcttagtcttt

SEQ ID NO: 81193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtctgttcatcttagtctt

SEQ ID NO: 81194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtttggtctgttcatct

SEQ ID NO: 81195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagttaaaagtttggtctgt

SEQ ID NO: 81196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagttaaaagtttggtct

SEQ ID NO: 81197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaagttaaaagtttggtc

SEQ ID NO: 81198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaaagttaaaagtttggt

SEQ ID NO: 81199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaaagttaaaagtttgg

SEQ ID NO: 81200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctaaagttaaaagtttg

SEQ ID NO: 81201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctaaagttaaaagttt

SEQ ID NO: 81202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttctaaagttaaaagtt

SEQ ID NO: 81203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttctaaagttaaaagt

SEQ ID NO: 81204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttctaaagttaaaag

SEQ ID NO: 81205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttctaaagttaaaa

SEQ ID NO: 81206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttttttttctaaagtta

SEQ ID NO: 81207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttttttttttctaaagtt

SEQ ID NO: 81208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatatcccacaatgtttgct

SEQ ID NO: 81209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaatatcccacaatgtttg

SEQ ID NO: 81210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcaatatcccacaatgttt

SEQ ID NO: 81211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttctcaatatcccacaat

SEQ ID NO: 81212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacttctcaatatcccacaa

SEQ ID NO: 81213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacttctcaatatcccaca

SEQ ID NO: 81214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actttaacttctcaatatcc

SEQ ID NO: 81215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaatactaactttaacttc

SEQ ID NO: 81216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taggaatactaactttaact

SEQ ID NO: 81217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaggaatactaactttaa

SEQ ID NO: 81218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctaggaatactaacttta

SEQ ID NO: 81219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatttctctaggaatacta

SEQ ID NO: 81220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcaaatttctctaggaata

SEQ ID NO: 81221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcctcaaatttctctagg

SEQ ID NO: 81222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctcctcaaatttctcta

SEQ ID NO: 81223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaagatactctgtctcc

SEQ ID NO: 81224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaaagatactctgtctc

SEQ ID NO: 81225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataaaagatactctgtct

SEQ ID NO: 81226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaataaaagatactctgtc

SEQ ID NO: 81227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaataaaagatactctgt

SEQ ID NO: 81228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaataaaagatactctg

SEQ ID NO: 81229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaataaaagatactct

SEQ ID NO: 81230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaataaaagatactc

SEQ ID NO: 81231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttaataaaagatact

SEQ ID NO: 81232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttaataaaagatac

SEQ ID NO: 81233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttaataaaagata

SEQ ID NO: 81234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttttttttttaataaaag

SEQ ID NO: 81235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagcctatttttttttttt

SEQ ID NO: 81236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtagcctattttttttttt

SEQ ID NO: 81237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtagcctatttttttttt

SEQ ID NO: 81238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtagcctattttttttt

SEQ ID NO: 81239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttggtagcctatttttt

SEQ ID NO: 81240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtttttggtagcctattt

SEQ ID NO: 81241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttgttgtttttggtagc

SEQ ID NO: 81242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccagaattgatgttgttgt

SEQ ID NO: 81243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acccagaattgatgttgttg

SEQ ID NO: 81244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacccagaattgatgttgtt

SEQ ID NO: 81245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaagcatgacctttaccc

SEQ ID NO: 81246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaaagcatgacctttacc

SEQ ID NO: 81247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcacaaagcatgaccttt

SEQ ID NO: 81248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttcacaaagcatgacctt

SEQ ID NO: 81249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttcacaaagcatgacct

SEQ ID NO: 81250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttcacaaagcatgacc

SEQ ID NO: 81251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtttcacaaagcatgac

SEQ ID NO: 81252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattttttgtttcacaaag

SEQ ID NO: 81253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgaaattttttgtttcaca

SEQ ID NO: 81254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactgaaattttttgtttca

SEQ ID NO: 81255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcaagcattctactgaaat

SEQ ID NO: 81256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcaagcattctactgaaa

SEQ ID NO: 81257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagcaagcattctactgaa

SEQ ID NO: 81258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagcaagcattctactga

SEQ ID NO: 81259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttcagcaagcattctac

SEQ ID NO: 81260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccttttcagcaagcattct

SEQ ID NO: 81261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccttttcagcaagcattc

SEQ ID NO: 81262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacttctccttttcagcaa

SEQ ID NO: 81263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caattatgacttctcctttt

SEQ ID NO: 81264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtaaagtaaaaggtaacta

SEQ ID NO: 81265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtaaagtaaaaggtaact

SEQ ID NO: 81266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggtaaagtaaaaggtaac

SEQ ID NO: 81267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgggtaaagtaaaaggtaa

SEQ ID NO: 81268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaaagtgccccttttgggt

SEQ ID NO: 81269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtaaagtgccccttttgg

SEQ ID NO: 81270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgccccattctggtaaagt

SEQ ID NO: 81271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actggtgccccattctggta

SEQ ID NO: 81272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatgctcactggtgcccc

SEQ ID NO: 81273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcacctgagaatgctcactg

SEQ ID NO: 81274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagcacctgagaatgctcac

SEQ ID NO: 81275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagcacctgagaatgctca

SEQ ID NO: 81276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgtaaccatcacataga

SEQ ID NO: 81277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatgtaaccatcacatag

SEQ ID NO: 81278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccatgtaaccatcacata

SEQ ID NO: 81279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatacatattttcccatg

SEQ ID NO: 81280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatatacatattttcccat

SEQ ID NO: 81281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatatacatattttccca

SEQ ID NO: 81282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacatatacatattttccc

SEQ ID NO: 81283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgcatttttacatataca

SEQ ID NO: 81284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agatatagaactccatgcat

SEQ ID NO: 81285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatatatagaaaaatctaa

SEQ ID NO: 81286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaaaatatatagaaaaatc

SEQ ID NO: 81287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctaaaatatatagaaaaa

SEQ ID NO: 81288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattctcctaaaatatata

SEQ ID NO: 81289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaattctcctaaaatatat

SEQ ID NO: 81290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaattctcctaaaatata

SEQ ID NO: 81291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaattctcctaaaatat

SEQ ID NO: 81292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttaaaattctcctaaa

SEQ ID NO: 81293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttttaaaattctcctaa

SEQ ID NO: 81294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttttaaaattctccta

SEQ ID NO: 81295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatttttaaaattctcct

SEQ ID NO: 81296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatttttaaaattctcc

SEQ ID NO: 81297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaatttttaaaattctc

SEQ ID NO: 81298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttttttaatttttaaaa

SEQ ID NO: 81299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacttttttaatttttaaa

SEQ ID NO: 81300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacttttttaatttttaa

SEQ ID NO: 81301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtacttttttaatttt

SEQ ID NO: 81302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttgtacttttttaattt

SEQ ID NO: 81303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttgtacttttttaatt

SEQ ID NO: 81304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttttattttgtacttttt

SEQ ID NO: 81305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagttttattttgtacttt

SEQ ID NO: 81306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaagttttattttgtactt

SEQ ID NO: 81307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcttctaagttttatttt

SEQ ID NO: 81308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatcttctaagttttatt

SEQ ID NO: 81309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgtatcttctaagtttt

SEQ ID NO: 81310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtcgaacaacatggatta

SEQ ID NO: 81311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agactaatgtcgaacaacat

SEQ ID NO: 81312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagactaatgtcgaacaaca

SEQ ID NO: 81313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgagactaatgtcgaacaa

SEQ ID NO: 81314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgagactaatgtcgaac

SEQ ID NO: 81315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctcttgagactaatgtcg

SEQ ID NO: 81316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgctctcttgagactaatg

SEQ ID NO: 81317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgctctcttgagactaat

SEQ ID NO: 81318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgctgctctcttgagact

SEQ ID NO: 81319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatttgctgctctcttgag

SEQ ID NO: 81320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctactatttgctgctctct

SEQ ID NO: 81321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatctactatttgctgctc

SEQ ID NO: 81322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatctactatttgctgct

SEQ ID NO: 81323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcctatctactatttgct

SEQ ID NO: 81324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttcctatctactattt

SEQ ID NO: 81325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatttcctatctactatt

SEQ ID NO: 81326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttattatttcctatctact

SEQ ID NO: 81327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttattatttcctatctac

SEQ ID NO: 81328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttattatttcctatcta

SEQ ID NO: 81329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgtttattatttcctat

SEQ ID NO: 81330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccattactttgtttattatt

SEQ ID NO: 81331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccattactttgtttatta

SEQ ID NO: 81332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgccattactttgtttatt

SEQ ID NO: 81333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgccattactttgtttat

SEQ ID NO: 81334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgaattttctgccattact

SEQ ID NO: 81335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtgaattttctgccattac

SEQ ID NO: 81336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggtgaattttctgccatt

SEQ ID NO: 81337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgactcttggtgaattttc

SEQ ID NO: 81338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgactcttggtgaatttt

SEQ ID NO: 81339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttgatgactcttggtgaa

SEQ ID NO: 81340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcttgatgactcttggtga

SEQ ID NO: 81341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcttgatgactcttggtg

SEQ ID NO: 81342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagcttgatgactcttggt

SEQ ID NO: 81343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttttagcttgatgactc

SEQ ID NO: 81344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacttttagcttgatgact

SEQ ID NO: 81345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacttttagcttgatgac

SEQ ID NO: 81346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtacttttagcttgatga

SEQ ID NO: 81347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgtacttttagcttgat

SEQ ID NO: 81348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttgtacttttagcttga

SEQ ID NO: 81349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcttcttttgtacttttag

SEQ ID NO: 81350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgatcttcttttgtact

SEQ ID NO: 81351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattgatcttcttttgtac

SEQ ID NO: 81352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattgatcttcttttgta

SEQ ID NO: 81353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaattgatcttcttttgt

SEQ ID NO: 81354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaagaatggaacttttaaa

SEQ ID NO: 81355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaagaatggaacttttaa

SEQ ID NO: 81356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacaagaatggaactttta

SEQ ID NO: 81357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactttcacaagaatggaac

SEQ ID NO: 81358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaactttcacaagaatgga

SEQ ID NO: 81359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgctctaaactttcacaag

SEQ ID NO: 81360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatgctctaaactttcac

SEQ ID NO: 81361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgttaatgctctaaacttt

SEQ ID NO: 81362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattgttaatgctctaaact

SEQ ID NO: 81363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattgttaatgctctaaac

SEQ ID NO: 81364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctattgttaatgctcta

SEQ ID NO: 81365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttctattgttaatgctct

SEQ ID NO: 81366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaatcttgtttctattgt

SEQ ID NO: 81367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagattataaaatcttgtt

SEQ ID NO: 81368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaagattataaaatcttgt

SEQ ID NO: 81369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaagattataaaatcttg

SEQ ID NO: 81370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggaagattataaaatctt

SEQ ID NO: 81371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttggaagattataaaat

SEQ ID NO: 81372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttttggaagattataaaa

SEQ ID NO: 81373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttatttttggaagattat

SEQ ID NO: 81374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatcttatttttggaaga

SEQ ID NO: 81375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttagttatcttatttttgg

SEQ ID NO: 81376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttagttatcttatttttg

SEQ ID NO: 81377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttagttatcttattttt

SEQ ID NO: 81378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagttagttatcttatttt

SEQ ID NO: 81379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagttagttatcttattt

SEQ ID NO: 81380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttagttagttatcttat

SEQ ID NO: 81381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctttttagttagttatc

SEQ ID NO: 81382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattctttttagttagttat

SEQ ID NO: 81383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattctttttagttagtta

SEQ ID NO: 81384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttcattctttttagtta

SEQ ID NO: 81385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggcaatctaattttcatt

SEQ ID NO: 81386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggcaatctaattttcat

SEQ ID NO: 81387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatggcaatctaattttca

SEQ ID NO: 81388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggaaattttaatggcaatc

SEQ ID NO: 81389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctaaggaaattttaatg

SEQ ID NO: 81390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgtcaattatggctaagga

SEQ ID NO: 81391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtgtcaattatggctaag

SEQ ID NO: 81392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttctagtgtcaattatgg

SEQ ID NO: 81393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgtgttctagtgtcaatt

SEQ ID NO: 81394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagcattgattgtgttcta

SEQ ID NO: 81395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcacactgaaagcattgat

SEQ ID NO: 81396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatcacactgaaagcattg

SEQ ID NO: 81397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcatcacactgaaagcat

SEQ ID NO: 81398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctcatcacactgaaagca

SEQ ID NO: 81399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctcatcacactgaaagc

SEQ ID NO: 81400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatattttctctcatcac

SEQ ID NO: 81401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcaaaatattttctctca

SEQ ID NO: 81402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattcaaaatattttctctc

SEQ ID NO: 81403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatagaatttgattcaaa

SEQ ID NO: 81404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgataatagaatttgatt

SEQ ID NO: 81405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataataggttgtctgataat

SEQ ID NO: 81406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gataataggttgtctgataa

SEQ ID NO: 81407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatcacacttgataatagg

SEQ ID NO: 81408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccatcacacttgataatag

SEQ ID NO: 81409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgccatcacacttgataa

SEQ ID NO: 81410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgccatcacacttgata

SEQ ID NO: 81411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttgccatcacacttgat

SEQ ID NO: 81412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatatattttgtttgcca

SEQ ID NO: 81413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacctagaaatatattttgt

SEQ ID NO: 81414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacctagaaatatattttg

SEQ ID NO: 81415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatacctagaaatatattt

SEQ ID NO: 81416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatacctagaaatatatt

SEQ ID NO: 81417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttatacctagaaatatat

SEQ ID NO: 81418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttcttatacctagaaa

SEQ ID NO: 81419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattttcttatacctagaa

SEQ ID NO: 81420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaattttcttatacctaga

SEQ ID NO: 81421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttgaattttcttatac

SEQ ID NO: 81422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaagataaaaagga

SEQ ID NO: 81423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaaaaaaagataaaaagg

SEQ ID NO: 81424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atccaaagtaacttaaaaaa

SEQ ID NO: 81425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatccaaagtaacttaaaaa

SEQ ID NO: 81426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttaatccaaagtaactta

SEQ ID NO: 81427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taccttaatccaaagtaact

SEQ ID NO: 81428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctaccttaatccaaagta

SEQ ID NO: 81429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctctaccttaatccaaagt

SEQ ID NO: 81430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctctaccttaatccaaag

SEQ ID NO: 81431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctctaccttaatccaaa

SEQ ID NO: 81432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgctctaccttaatccaa

SEQ ID NO: 81433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgctctaccttaatcca

SEQ ID NO: 81434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgctctaccttaatcc

SEQ ID NO: 81435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgctctaccttaatc

SEQ ID NO: 81436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgctctaccttaat

SEQ ID NO: 81437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgctctaccttaa

SEQ ID NO: 81438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgctctacctta

SEQ ID NO: 81439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttgctctacctt

SEQ ID NO: 81440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagtacttttttttttttg

SEQ ID NO: 81441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaagtactttttttttttt

SEQ ID NO: 81442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaagtacttttttttttt

SEQ ID NO: 81443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgttttagaagtactttt

SEQ ID NO: 81444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtgttttagaagtactt

SEQ ID NO: 81445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattctatgtgttttagaag

SEQ ID NO: 81446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtattctatgtgttttagaa

SEQ ID NO: 81447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaacatcttgtattctat

SEQ ID NO: 81448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaaacatcttgtattcta

SEQ ID NO: 81449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgtgaaacatcttgtatt

SEQ ID NO: 81450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acactatttgtgaaacatct

SEQ ID NO: 81451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcacactatttgtgaaaca

SEQ ID NO: 81452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcacactatttgtgaaac

SEQ ID NO: 81453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcacactatttgtgaaa

SEQ ID NO: 81454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattcacactatttgtgaa

SEQ ID NO: 81455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttattcacactatttgt

SEQ ID NO: 81456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttttattcacactatttg

SEQ ID NO: 81457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcttttattcacactattt

SEQ ID NO: 81458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctttgcttttattcacact

SEQ ID NO: 81459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagaaacaaattccctttgc

SEQ ID NO: 81460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagaaacaaattcccttt

SEQ ID NO: 81461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacgttctaaagaaacaaat

SEQ ID NO: 81462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacgttctaaagaaacaaa

SEQ ID NO: 81463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttacacgttctaaagaaac

SEQ ID NO: 81464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacaatatggctatttacac

SEQ ID NO: 81465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacaatatggctatttaca

SEQ ID NO: 81466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttggacaatatggctattt

SEQ ID NO: 81467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatttggacaatatggcta

SEQ ID NO: 81468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcctatttggacaatatg

SEQ ID NO: 81469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgattcctatttggaca

SEQ ID NO: 81470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattgattcctatttggac

SEQ ID NO: 81471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaattgattcctatttgga

SEQ ID NO: 81472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attttgaattgattcctatt

SEQ ID NO: 81473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcctcattttgaattgat

SEQ ID NO: 81474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttcatgcctcattttga

SEQ ID NO: 81475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaagttcatgcctcattt

SEQ ID NO: 81476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccagttgttcaagttcatgc

SEQ ID NO: 81477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taccagttgttcaagttcat

SEQ ID NO: 81478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattctaccagttgttcaag

SEQ ID NO: 81479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caattctaccagttgttcaa

SEQ ID NO: 81480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttcaattctaccagttgtt

SEQ ID NO: 81481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcttcaattctaccagttg

SEQ ID NO: 81482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgcttcaattctaccagt

SEQ ID NO: 81483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtggatcctctctgcttc

SEQ ID NO: 81484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaacacatcaaactcaag

SEQ ID NO: 81485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagaacacatcaaactcaa

SEQ ID NO: 81486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgaagaacacatcaaact

SEQ ID NO: 81487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacttgaagaacacatcaa

SEQ ID NO: 81488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctacttgaagaacacatc

SEQ ID NO: 81489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactctgctacttgaagaa

SEQ ID NO: 81490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcaaactctgctacttga

SEQ ID NO: 81491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcattcaaactctgctactt

SEQ ID NO: 81492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacctctcattcaaactctg

SEQ ID NO: 81493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacctctcattcaaactct

SEQ ID NO: 81494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggaggaatttaaacctct

SEQ ID NO: 81495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctagaggaggaatttaaa

SEQ ID NO: 81496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatctagaggaggaatttaa

SEQ ID NO: 81497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacaagtaacatggtttga

SEQ ID NO: 81498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacaagtaacatggtttg

SEQ ID NO: 81499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacaagtaacatggttt

SEQ ID NO: 81500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttaaaacaagtaacatg

SEQ ID NO: 81501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttaaaacaagtaacat

SEQ ID NO: 81502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattttaaaacaagtaaca

SEQ ID NO: 81503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattttaaaacaagtaac

SEQ ID NO: 81504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatgtatttttcatttta

SEQ ID NO: 81505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattatgtatgtatttttc

SEQ ID NO: 81506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaatattataattatgtat

SEQ ID NO: 81507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaatattataattatgta

SEQ ID NO: 81508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atacaatttaacaatattat

SEQ ID NO: 81509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgatacaatttaacaata

SEQ ID NO: 81510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagatgattaactgataca

SEQ ID NO: 81511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgagatgattaactgatac

SEQ ID NO: 81512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacatttgtgagatgatta

SEQ ID NO: 81513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaattggcacatttgtgag

SEQ ID NO: 81514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaattggcacatttgtga

SEQ ID NO: 81515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtaattggcacatttgtg

SEQ ID NO: 81516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatgctttggtaattggc

SEQ ID NO: 81517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatgctttggtaattgg

SEQ ID NO: 81518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatatgctttggtaattg

SEQ ID NO: 81519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattttatatatgctttggt

SEQ ID NO: 81520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acattttatatatgctttgg

SEQ ID NO: 81521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttacattttatatatgc

SEQ ID NO: 81522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taattgtacttacattttat

SEQ ID NO: 81523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataattgtacttacatttt

SEQ ID NO: 81524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaaataaagttctataat

SEQ ID NO: 81525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtaaataaagttctataa

SEQ ID NO: 81526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtaaataaagttctata

SEQ ID NO: 81527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttgtgtaaataaagttc

SEQ ID NO: 81528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctttgtgtaaataaagtt

SEQ ID NO: 81529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacatatatgtgtatatct

SEQ ID NO: 81530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacacatatatgtgtatatc

SEQ ID NO: 81531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatatttaacacatatat

SEQ ID NO: 81532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactgataatatttaacaca

SEQ ID NO: 81533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactgataatatttaacac

SEQ ID NO: 81534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacactgataatatttaaca

SEQ ID NO: 81535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacactgataatatttaac

SEQ ID NO: 81536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttacactgataatattt

SEQ ID NO: 81537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattacttttacactgataa

SEQ ID NO: 81538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttccattacttttacactga

SEQ ID NO: 81539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagctattccattactttt

SEQ ID NO: 81540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaagctattccattacttt

SEQ ID NO: 81541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaagctattccattactt

SEQ ID NO: 81542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaagctattccattact

SEQ ID NO: 81543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatttttgtaagctattcca

SEQ ID NO: 81544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaatttttgtaagctattc

SEQ ID NO: 81545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctctcaatttttgtaagct

SEQ ID NO: 81546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacctctcaatttttgtaag

SEQ ID NO: 81547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccccctctacctctcaat

SEQ ID NO: 81548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accactaatccccctctacc

SEQ ID NO: 81549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcaccactaatccccctc

SEQ ID NO: 81550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctcaccactaatccccct

SEQ ID NO: 81551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctcaccactaatccccc

SEQ ID NO: 81552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccctcaccactaatcccc

SEQ ID NO: 81553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caacttttccctcaccacta

SEQ ID NO: 81554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccaacttttccctcaccac

SEQ ID NO: 81555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgtaagataaggggtcag

SEQ ID NO: 81556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatgtaagataaggggtca

SEQ ID NO: 81557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttcaatgtaagataaggg

SEQ ID NO: 81558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgccttcaatgtaagata

SEQ ID NO: 81559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaggatgcactaactgcc

SEQ ID NO: 81560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agccaggatgcactaactgc

SEQ ID NO: 81561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagccaggatgcactaactg

SEQ ID NO: 81562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactttagccaggatgcact

SEQ ID NO: 81563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaactttagccaggatgcac

SEQ ID NO: 81564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttaaactttagccaggatg

SEQ ID NO: 81565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacttaaactttagccagg

SEQ ID NO: 81566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttacttaaactttagccag

SEQ ID NO: 81567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgttacttaaactttagcc

SEQ ID NO: 81568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgttacttaaactttagc

SEQ ID NO: 81569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcttgttacttaaacttt

SEQ ID NO: 81570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatttcttgttacttaaact

SEQ ID NO: 81571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacctctatttcttgttact

SEQ ID NO: 81572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatggaatatacctgaacct

SEQ ID NO: 81573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatggaatatacctgaacc

SEQ ID NO: 81574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatggaatatacctgaac

SEQ ID NO: 81575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacctttaaatggaatatac

SEQ ID NO: 81576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacctttaaatggaatata

SEQ ID NO: 81577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatttatacctttaaatgga

SEQ ID NO: 81578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgggttggatttataccttt

SEQ ID NO: 81579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgggttggatttatacct

SEQ ID NO: 81580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaattctatgggttggat

SEQ ID NO: 81581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagtaattctatgggttgg

SEQ ID NO: 81582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagtaattctatgggttg

SEQ ID NO: 81583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttctaagtaattctatgg

SEQ ID NO: 81584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttctaagtaattctatg

SEQ ID NO: 81585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttctaagtaattctat

SEQ ID NO: 81586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttttcatttctaagtaat

SEQ ID NO: 81587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagcagttatgttttcatt

SEQ ID NO: 81588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaattccaagcagttatgtt

SEQ ID NO: 81589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaattccaagcagttatg

SEQ ID NO: 81590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccccattctcaaattccaag

SEQ ID NO: 81591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccccattctcaaattcca

SEQ ID NO: 81592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgccccattctcaaattcc

SEQ ID NO: 81593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgccccattctcaaattc

SEQ ID NO: 81594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctgccccattctcaaat

SEQ ID NO: 81595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttctgccccattctcaa

SEQ ID NO: 81596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctttctgccccattctca

SEQ ID NO: 81597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctttctgccccattctc

SEQ ID NO: 81598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctctttctgccccattct

SEQ ID NO: 81599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaaacttttctctttctg

SEQ ID NO: 81600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaaacttttctctttct

SEQ ID NO: 81601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatgtaaacttttctctt

SEQ ID NO: 81602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatgtaaacttttctct

SEQ ID NO: 81603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttatgtaaacttttctc

SEQ ID NO: 81604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatttatgtaaactttt

SEQ ID NO: 81605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttatttatgtaaacttt

SEQ ID NO: 81606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatgaggaatttatttta

SEQ ID NO: 81607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaatgaggaatttatttt

SEQ ID NO: 81608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttgaaaatgaggaattta

SEQ ID NO: 81609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttgaaaatgaggaatt

SEQ ID NO: 81610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatttgaaaatgaggaat

SEQ ID NO: 81611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctaatttgaaaatgaggaa

SEQ ID NO: 81612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actttctaatttgaaaatga

SEQ ID NO: 81613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactttctaatttgaaaat

SEQ ID NO: 81614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaactttctaatttgaaaa

SEQ ID NO: 81615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaactttctaatttgaaa

SEQ ID NO: 81616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaatgttttctaactttc

SEQ ID NO: 81617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtaatgttttctaacttt

SEQ ID NO: 81618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaacttatgtaatgtttt

SEQ ID NO: 81619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcaacttatgtaatgttt

SEQ ID NO: 81620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcatcaacttatgtaatg

SEQ ID NO: 81621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcatcaacttatgtaat

SEQ ID NO: 81622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcatcaacttatgtaa

SEQ ID NO: 81623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttcatcaacttatgta

SEQ ID NO: 81624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttttatttcatcaactta

SEQ ID NO: 81625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtctcatttttatttcatc

SEQ ID NO: 81626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtctcatttttatttcat

SEQ ID NO: 81627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataatatgcttatgtctca

SEQ ID NO: 81628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaataatatgcttatgtct

SEQ ID NO: 81629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctctaaataatatgcttat

SEQ ID NO: 81630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctctaaataatatgctta

SEQ ID NO: 81631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctctaaataatatgctt

SEQ ID NO: 81632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatctctaaataatatgct

SEQ ID NO: 81633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatctctaaataatatgc

SEQ ID NO: 81634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttttatctctaaataata

SEQ ID NO: 81635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttttatctctaaataat

SEQ ID NO: 81636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctttttatctctaaataa

SEQ ID NO: 81637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atattttcctttttatctct

SEQ ID NO: 81638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatattttcctttttatct

SEQ ID NO: 81639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatattttcctttttatc

SEQ ID NO: 81640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgatattttcctttttat

SEQ ID NO: 81641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgatattttccttttta

SEQ ID NO: 81642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaagtttttctgatat

SEQ ID NO: 81643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaaagtttttctgata

SEQ ID NO: 81644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaaaagtttttctgat

SEQ ID NO: 81645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaaaagtttttctga

SEQ ID NO: 81646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaaaaagtttttctg

SEQ ID NO: 81647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaaaaaaaagtttttct

SEQ ID NO: 81648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccgcttttttaaaaaaaagt

SEQ ID NO: 81649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccgcttttttaaaaaaaag

SEQ ID NO: 81650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggaataatcacttcccgct

SEQ ID NO: 81651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctagggaataatcacttcc

SEQ ID NO: 81652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagccattatctagggaata

SEQ ID NO: 81653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagccattatctagggaat

SEQ ID NO: 81654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagccattatctagggaa

SEQ ID NO: 81655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccctttaaagccattatct

SEQ ID NO: 81656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccctttaaagccattatc

SEQ ID NO: 81657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatccctttaaagccattat

SEQ ID NO: 81658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttatccctttaaagccat

SEQ ID NO: 81659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctttatccctttaaagcca

SEQ ID NO: 81660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctttatccctttaaagcc

SEQ ID NO: 81661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctttatccctttaaagc

SEQ ID NO: 81662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacaatttttgctttatcc

SEQ ID NO: 81663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcaaacaatttttgcttt

SEQ ID NO: 81664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaatgcacatggtaacta

SEQ ID NO: 81665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaattaacaaatgcacat

SEQ ID NO: 81666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttataaaattaacaaatgca

SEQ ID NO: 81667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcataataataactattat

SEQ ID NO: 81668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcataataataactatta

SEQ ID NO: 81669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatcataataataactatt

SEQ ID NO: 81670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatcataataataactat

SEQ ID NO: 81671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaatcataataataacta

SEQ ID NO: 81672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagctttttaatcataataa

SEQ ID NO: 81673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagctttttaatcataata

SEQ ID NO: 81674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagctttttaatcataat

SEQ ID NO: 81675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttacagctttttaatcat

SEQ ID NO: 81676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttacagctttttaatca

SEQ ID NO: 81677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttacagctttttaatc

SEQ ID NO: 81678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattttacagctttttaat

SEQ ID NO: 81679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttattttacagcttttta

SEQ ID NO: 81680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttttattttacagcttttt

SEQ ID NO: 81681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagagagaggtataatatct

SEQ ID NO: 81682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcaagagagaggtataat

SEQ ID NO: 81683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctcaagagagaggtataa

SEQ ID NO: 81684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggctcaagagagaggtata

SEQ ID NO: 81685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggctcaagagagaggta

SEQ ID NO: 81686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttggctcaagagagaggt

SEQ ID NO: 81687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttctttggctcaagagag

SEQ ID NO: 81688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggtttctttggctcaaga

SEQ ID NO: 81689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttggtttctttggctcaag

SEQ ID NO: 81690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgttggtttctttggctc

SEQ ID NO: 81691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcagctgtttgttggtttc

SEQ ID NO: 81692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagcagctgtttgttggttt

SEQ ID NO: 81693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttaagcagctgtttgttgg

SEQ ID NO: 81694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacttaagcagctgtttgtt

SEQ ID NO: 81695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacttaagcagctgtttgt

SEQ ID NO: 81696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcccagtgaaggtaacag

SEQ ID NO: 81697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagcccagtgaaggtaaca

SEQ ID NO: 81698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagcccagtgaaggtaac

SEQ ID NO: 81699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaagcccagtgaaggtaa

SEQ ID NO: 81700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaggtgtagagtcagtcca

SEQ ID NO: 81701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaggtgtagagtcagtcc

SEQ ID NO: 81702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatatatggtgtttgaaagg

SEQ ID NO: 81703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagagatcaaaataatgta

SEQ ID NO: 81704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgaaagagatcaaaataa

SEQ ID NO: 81705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgaaagagatcaaaata

SEQ ID NO: 81706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatttacctgaaagagatc

SEQ ID NO: 81707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctccaatttacctgaaaga

SEQ ID NO: 81708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaattgtctccaatttacc

SEQ ID NO: 81709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaaatgaattgcaaatt

SEQ ID NO: 81710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaagaaatattaataaaa

SEQ ID NO: 81711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagaagaaatattaataaa

SEQ ID NO: 81712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgtgtcagatggtccct

SEQ ID NO: 81713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagtgtgtcagatggtccc

SEQ ID NO: 81714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgtttgcagtgtgtcaga

SEQ ID NO: 81715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtgtttgcagtgtgtcag

SEQ ID NO: 81716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagtgtttgcagtgtgtca

SEQ ID NO: 81717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taactttgagtgtttgcagt

SEQ ID NO: 81718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaactttgagtgtttgc

SEQ ID NO: 81719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtaactttgagtgtttg

SEQ ID NO: 81720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactgtaactttgagtgttt

SEQ ID NO: 81721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcagagaaagtagaagaca

SEQ ID NO: 81722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctaagcagagaaagtaga

SEQ ID NO: 81723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtattcatctaagcagaga

SEQ ID NO: 81724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagcacccaatgaagtgtt

SEQ ID NO: 81725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcaagccagccattggtag

SEQ ID NO: 81726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaccatgcattcagcaag

SEQ ID NO: 81727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaaaaccatgcattcagc

SEQ ID NO: 81728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atattgttgaaaaccatgca

SEQ ID NO: 81729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtcagataataggaagat

SEQ ID NO: 81730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggaagaattggtgtcagat

SEQ ID NO: 81731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actatggaagaattggtgtc

SEQ ID NO: 81732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagctcactatggaagaat

SEQ ID NO: 81733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtatcatgtaatgcccaca

SEQ ID NO: 81734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattaagtatcatgtaatg

SEQ ID NO: 81735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggtattaagtatcatgta

SEQ ID NO: 81736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggttattggtattaagta

SEQ ID NO: 81737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttgtgggttattggtatt

SEQ ID NO: 81738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgttgtgggttattggtat

SEQ ID NO: 81739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgttgtgggttattggta

SEQ ID NO: 81740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttgtgttgtgggttatt

SEQ ID NO: 81741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaacagcagataataaaa

SEQ ID NO: 81742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaacagcagataataaa

SEQ ID NO: 81743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaaacagcagataataa

SEQ ID NO: 81744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacagtagtattttggaaa

SEQ ID NO: 81745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacagtagtattttggaa

SEQ ID NO: 81746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacagtagtattttgga

SEQ ID NO: 81747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acataagtgaaagggatttt

SEQ ID NO: 81748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctaacataagtgaaaggga

SEQ ID NO: 81749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattacctaacataagtga

SEQ ID NO: 81750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacattacctaacataagtg

SEQ ID NO: 81751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacattacctaacataagt

SEQ ID NO: 81752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacattacctaacataag

SEQ ID NO: 81753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catttttaacattacctaac

SEQ ID NO: 81754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgcatttttaacattacc

SEQ ID NO: 81755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agctgcatttttaacattac

SEQ ID NO: 81756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaccatagagacaaatga

SEQ ID NO: 81757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacaaccatagagacaaatg

SEQ ID NO: 81758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgacaaccatagagacaaa

SEQ ID NO: 81759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatatacactcttgacaac

SEQ ID NO: 81760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatatatacactcttgaca

SEQ ID NO: 81761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattctgatatatacactct

SEQ ID NO: 81762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcaatagccacagtggagt

SEQ ID NO: 81763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataccctggtcaatagcca

SEQ ID NO: 81764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtataccctggtcaatagcc

SEQ ID NO: 81765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtataccctggtcaatagc

SEQ ID NO: 81766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtataccctggtcaatag

SEQ ID NO: 81767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtataccctggtcaata

SEQ ID NO: 81768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtataccctggtcaat

SEQ ID NO: 81769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacagatgatttttttgtat

SEQ ID NO: 81770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttacacagatgatttttt

SEQ ID NO: 81771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggttacacagatgattttt

SEQ ID NO: 81772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggttacacagatgatttt

SEQ ID NO: 81773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaggttacacagatgattt

SEQ ID NO: 81774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaggttacacagatgatt

SEQ ID NO: 81775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaggttacacagatgat

SEQ ID NO: 81776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttttttaggttacacag

SEQ ID NO: 81777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcatctgtatttttttaggt

SEQ ID NO: 81778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataagccctggcatctgta

SEQ ID NO: 81779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agataagccctggcatctgt

SEQ ID NO: 81780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttagataagccctggcatc

SEQ ID NO: 81781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcattacttagataagccc

SEQ ID NO: 81782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcattacttagataagcc

SEQ ID NO: 81783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcagcattacttagataa

SEQ ID NO: 81784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttcagcattacttagata

SEQ ID NO: 81785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttcagcattacttagat

SEQ ID NO: 81786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttcagcattacttaga

SEQ ID NO: 81787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacttttatttcagcatta

SEQ ID NO: 81788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctaaaacttttatttcagc

SEQ ID NO: 81789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctaaaacttttatttcag

SEQ ID NO: 81790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccctaaaacttttatttc

SEQ ID NO: 81791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctcttccctaaaactttt

SEQ ID NO: 81792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgctcttccctaaaacttt

SEQ ID NO: 81793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtagacatgcttatgct

SEQ ID NO: 81794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagtagacatgcttatgc

SEQ ID NO: 81795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagtagacatgcttatg

SEQ ID NO: 81796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaagtagacatgcttat

SEQ ID NO: 81797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaaagtagacatgctta

SEQ ID NO: 81798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctttttaaaagtagacat

SEQ ID NO: 81799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgctttttaaaagtagaca

SEQ ID NO: 81800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgctttttaaaagtagac

SEQ ID NO: 81801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtattttatgctttttaaaa

SEQ ID NO: 81802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgttagtattttatgcttt

SEQ ID NO: 81803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaaatcaaatggagggtt

SEQ ID NO: 81804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaaaatcaaatggagggt

SEQ ID NO: 81805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttaacaaaatcaaatgga

SEQ ID NO: 81806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttaacaaaatcaaatgg

SEQ ID NO: 81807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttaacaaaatcaaatg

SEQ ID NO: 81808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatttaacaaaatcaaat

SEQ ID NO: 81809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatttttgatttaacaaaa

SEQ ID NO: 81810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctgatatttttgatttaa

SEQ ID NO: 81811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtatgtgtactcatctga

SEQ ID NO: 81812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcattgatgtatgtgtact

SEQ ID NO: 81813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataataaaacctggtcatt

SEQ ID NO: 81814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataataaaacctggtcat

SEQ ID NO: 81815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaataataaaacctggtca

SEQ ID NO: 81816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaataataaaacctggtc

SEQ ID NO: 81817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttgaataataaaacctg

SEQ ID NO: 81818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccttttgaataataaaacc

SEQ ID NO: 81819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctccttttgaataataaaa

SEQ ID NO: 81820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctccttttgaataataaa

SEQ ID NO: 81821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctccttttgaataataa

SEQ ID NO: 81822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctccttttgaataata

SEQ ID NO: 81823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctctccttttgaataat

SEQ ID NO: 81824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttttctctccttttga

SEQ ID NO: 81825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgaattttttctctcct

SEQ ID NO: 81826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattgaattttttctctcc

SEQ ID NO: 81827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaattgaattttttctctc

SEQ ID NO: 81828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaattgaattttttctct

SEQ ID NO: 81829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgaattgaattttttctc

SEQ ID NO: 81830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttttgaattgaatttttt

SEQ ID NO: 81831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactttttgaattgaatttt

SEQ ID NO: 81832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactttttgaattgaattt

SEQ ID NO: 81833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctactttttgaattgaatt

SEQ ID NO: 81834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctactttttgaattgaat

SEQ ID NO: 81835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaccaaacaaaatccaaaa

SEQ ID NO: 81836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaccaaacaaaatccaaa

SEQ ID NO: 81837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttcaaaccaaacaaaatc

SEQ ID NO: 81838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtcttcaaaccaaacaa

SEQ ID NO: 81839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattcattgtcttcaaacca

SEQ ID NO: 81840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattcattgtcttcaaacc

SEQ ID NO: 81841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattcattgtcttcaaac

SEQ ID NO: 81842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtattttacattcattgtc

SEQ ID NO: 81843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttgtgtattttacattc

SEQ ID NO: 81844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagttgtgtattttacatt

SEQ ID NO: 81845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagttgtgtattttacat

SEQ ID NO: 81846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actttaaagttgtgtatttt

SEQ ID NO: 81847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatagttaactttaaagtt

SEQ ID NO: 81848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatagttaactttaaagt

SEQ ID NO: 81849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatagttaactttaaag

SEQ ID NO: 81850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caattttaaaatagttaact

SEQ ID NO: 81851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaattttaaaatagttaac

SEQ ID NO: 81852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccaattttaaaatagttaa

SEQ ID NO: 81853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctttccaattttaaaata

SEQ ID NO: 81854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcctttccaattttaaaat

SEQ ID NO: 81855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttatcctttccaatttt

SEQ ID NO: 81856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtttatcctttccaattt

SEQ ID NO: 81857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatggaatttatgtttatcc

SEQ ID NO: 81858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgaatggaatttatgttta

SEQ ID NO: 81859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtctattgaatggaatttat

SEQ ID NO: 81860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcctggtctattgaatgga

SEQ ID NO: 81861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcacgagccactgtgcc

SEQ ID NO: 81862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaattacaggcacgagccac

SEQ ID NO: 81863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgaaaatgttggaattacag

SEQ ID NO: 81864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctccgaaaatgttggaat

SEQ ID NO: 81865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcctccgaaaatgttggaa

SEQ ID NO: 81866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccgccttggcctccgaaa

SEQ ID NO: 81867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtgattcacccgccttgg

SEQ ID NO: 81868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctcaagtgattcacccgc

SEQ ID NO: 81869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgccctcaagtgattcacc

SEQ ID NO: 81870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcctgccctcaagtgat

SEQ ID NO: 81871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactcctgccctcaagtga

SEQ ID NO: 81872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaactcctgccctcaagt

SEQ ID NO: 81873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcttgaactcctgccctca

SEQ ID NO: 81874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatgctgttcttgaactc

SEQ ID NO: 81875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttgcccatgctgttcttg

SEQ ID NO: 81876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagacagggtgtcactgtgt

SEQ ID NO: 81877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagagacagggtgtcactg

SEQ ID NO: 81878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctagagacagggtgtcact

SEQ ID NO: 81879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctagagacagggtgtcac

SEQ ID NO: 81880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcctagagacagggtgtca

SEQ ID NO: 81881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttttcctagagacaggg

SEQ ID NO: 81882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacttttcctagagacagg

SEQ ID NO: 81883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacttttcctagagacag

SEQ ID NO: 81884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtacttttcctagagaca

SEQ ID NO: 81885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttttgtacttttcctaga

SEQ ID NO: 81886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaatttttgtacttttcc

SEQ ID NO: 81887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgcctggctaatttttgt

SEQ ID NO: 81888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggtgcacagctccatgcc

SEQ ID NO: 81889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agactacaggtgcacagctc

SEQ ID NO: 81890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagcagctgagactacaggt

SEQ ID NO: 81891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaagcagctgagactacag

SEQ ID NO: 81892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctcaagcagctgagacta

SEQ ID NO: 81893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctactctcaagcagctgag

SEQ ID NO: 81894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agctactctcaagcagctga

SEQ ID NO: 81895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaccttagctactctcaag

SEQ ID NO: 81896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtgatcctcccaccttag

SEQ ID NO: 81897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaggctcaggtgatcctc

SEQ ID NO: 81898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacctccccaggctcaggtg

SEQ ID NO: 81899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagactcaacctccccaggc

SEQ ID NO: 81900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcagactcaacctcccc

SEQ ID NO: 81901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaccgcagtggtgtgatcat

SEQ ID NO: 81902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatccaagctggaccgcag

SEQ ID NO: 81903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgtcatccaagctggacc

SEQ ID NO: 81904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctgtcatccaagctgga

SEQ ID NO: 81905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacagggtctctgtctgtc

SEQ ID NO: 81906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacagggtctctgtctgt

SEQ ID NO: 81907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagacagggtctctgtctg

SEQ ID NO: 81908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagacagggtctctgtct

SEQ ID NO: 81909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagacagggtctctgtc

SEQ ID NO: 81910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagacagggtctctgt

SEQ ID NO: 81911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagacagggtctctg

SEQ ID NO: 81912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagacagggtctct

SEQ ID NO: 81913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagacagggtctc

SEQ ID NO: 81914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagacagggtct

SEQ ID NO: 81915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagacagggtc

SEQ ID NO: 81916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagacagggt

SEQ ID NO: 81917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagacaggg

SEQ ID NO: 81918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgagacagg

SEQ ID NO: 81919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttgagacag

SEQ ID NO: 81920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagattttttttttttttt

SEQ ID NO: 81921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgatagatttttttttt

SEQ ID NO: 81922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgaattgatagattttttt

SEQ ID NO: 81923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattgaattgatagattttt

SEQ ID NO: 81924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattgaattgatagatttt

SEQ ID NO: 81925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctattgaattgatagat

SEQ ID NO: 81926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatatgtgttgtttctat

SEQ ID NO: 81927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggagttcaaaatatgtgttg

SEQ ID NO: 81928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacataatagagactcggag

SEQ ID NO: 81929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgaacataatagagactc

SEQ ID NO: 81930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgaacataatagagact

SEQ ID NO: 81931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattgaacataatagagac

SEQ ID NO: 81932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaattgaacataatagag

SEQ ID NO: 81933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaattgaacataataga

SEQ ID NO: 81934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttaattgaacataatag

SEQ ID NO: 81935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctttaattgaacataat

SEQ ID NO: 81936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttctttaattgaacataa

SEQ ID NO: 81937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctttctttaattgaacat

SEQ ID NO: 81938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caactcttctttctttaatt

SEQ ID NO: 81939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attccaactcttctttcttt

SEQ ID NO: 81940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctcattccaactcttctt

SEQ ID NO: 81941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccctcattccaactcttct

SEQ ID NO: 81942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccctcattccaactcttc

SEQ ID NO: 81943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccctcattccaactctt

SEQ ID NO: 81944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttttcccctcattccaa

SEQ ID NO: 81945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcagtttttcccctcatt

SEQ ID NO: 81946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattcagtttttcccctcat

SEQ ID NO: 81947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattcagtttttcccctca

SEQ ID NO: 81948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattcagtttttcccctc

SEQ ID NO: 81949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcattcagtttttcccct

SEQ ID NO: 81950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcattcagtttttcccc

SEQ ID NO: 81951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttttttcattcagtttt

SEQ ID NO: 81952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatttttttcattcagttt

SEQ ID NO: 81953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttccatttttttcattc

SEQ ID NO: 81954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacttccatttttttcatt

SEQ ID NO: 81955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttcaacttccatttttttc

SEQ ID NO: 81956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccttcaacttccatttttt

SEQ ID NO: 81957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctccttcaacttccatttt

SEQ ID NO: 81958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctccttcaacttccattt

SEQ ID NO: 81959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctctccttcaacttcca

SEQ ID NO: 81960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttctctccttcaacttcc

SEQ ID NO: 81961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatcttccttctctccttc

SEQ ID NO: 81962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatcttccttctctcctt

SEQ ID NO: 81963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttatcatcttccttctct

SEQ ID NO: 81964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttatcatcttccttctc

SEQ ID NO: 81965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtttatcatcttccttct

SEQ ID NO: 81966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtttatcatcttccttc

SEQ ID NO: 81967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttggtttatcatcttcctt

SEQ ID NO: 81968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctttttggtttatcatct

SEQ ID NO: 81969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accctttttggtttatcatc

SEQ ID NO: 81970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccctttttggtttatcat

SEQ ID NO: 81971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaccctttttggtttatca

SEQ ID NO: 81972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaccctttttggtttatc

SEQ ID NO: 81973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaccctttttggtttat

SEQ ID NO: 81974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaccctttttggttta

SEQ ID NO: 81975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttaccctttttggttt

SEQ ID NO: 81976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaacttttttttaccctt

SEQ ID NO: 81977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacattgaaaaactttttt

SEQ ID NO: 81978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagtaaatattaaaacat

SEQ ID NO: 81979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaattaaaaagtaaatatt

SEQ ID NO: 81980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgttgagaattaaaaag

SEQ ID NO: 81981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatgttgagaattaaaaa

SEQ ID NO: 81982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatgaagtgatataagtga

SEQ ID NO: 81983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taattggaatgaagtgatat

SEQ ID NO: 81984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaggctataattggaatga

SEQ ID NO: 81985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccaggctataattggaatg

SEQ ID NO: 81986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccaggctataattggaat

SEQ ID NO: 81987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaaaaaaaaaaaaaaaaa

SEQ ID NO: 81988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagagaataagagttaccaa

SEQ ID NO: 81989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagagaataagagttacca

SEQ ID NO: 81990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaagaacttggagagaata

SEQ ID NO: 81991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgcctcaaaagaacttgg

SEQ ID NO: 81992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaggagcactgcatgcct

SEQ ID NO: 81993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaggaggagcactgcatgc

SEQ ID NO: 81994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggatgagggatgagtgag

SEQ ID NO: 81995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggatgagggatgagtga

SEQ ID NO: 81996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaggtttggaggatgaggg

SEQ ID NO: 81997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagctgacaggtttggagga

SEQ ID NO: 81998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagctgacaggtttggagg

SEQ ID NO: 81999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagagctgacaggtttggag

SEQ ID NO: 82000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggatgctttagagctgaca

SEQ ID NO: 82001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actgaggatgctttagagct

SEQ ID NO: 82002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaacagattgactgaggat

SEQ ID NO: 82003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacaacagattgactgagga

SEQ ID NO: 82004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgacaacagattgactga

SEQ ID NO: 82005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcttgacaacagattgac

SEQ ID NO: 82006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgcttgacaacagattga

SEQ ID NO: 82007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttattgcttgacaacagat

SEQ ID NO: 82008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttattgcttgacaacaga

SEQ ID NO: 82009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgcttattgcttgacaaca

SEQ ID NO: 82010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgcttattgcttgacaac

SEQ ID NO: 82011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttgcttattgcttgaca

SEQ ID NO: 82012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcttgcttattgcttgac

SEQ ID NO: 82013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcttcttgcttattgctt

SEQ ID NO: 82014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttcttcttgcttattgct

SEQ ID NO: 82015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccttcttcttgcttattg

SEQ ID NO: 82016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcatcaagagttcttcct

SEQ ID NO: 82017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagcatcaagagttcttcc

SEQ ID NO: 82018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagcatcaagagttcttc

SEQ ID NO: 82019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttacagcatcaagagttc

SEQ ID NO: 82020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attattttacagcatcaaga

SEQ ID NO: 82021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattattttacagcatcaag

SEQ ID NO: 82022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgattattttacagcatca

SEQ ID NO: 82023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtaactcttgattatttt

SEQ ID NO: 82024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaaagacctaatgtaactc

SEQ ID NO: 82025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataaatgctaggaaagac

SEQ ID NO: 82026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataaatgctaggaaaga

SEQ ID NO: 82027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataaatgctaggaaag

SEQ ID NO: 82028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagatcagcgttttaaaat

SEQ ID NO: 82029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagttggaagatcagcgtt

SEQ ID NO: 82030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaaagttggaagatcagc

SEQ ID NO: 82031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacattcctgaaagttggaa

SEQ ID NO: 82032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacacattcctgaaagttg

SEQ ID NO: 82033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgttgttacacattcctg

SEQ ID NO: 82034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatgttgttacacattcct

SEQ ID NO: 82035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatgttgttacacattcc

SEQ ID NO: 82036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaatgttgttacacattc

SEQ ID NO: 82037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgaatgttgttacacatt

SEQ ID NO: 82038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgaatgttgttacaca

SEQ ID NO: 82039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttgaatgttgttacac

SEQ ID NO: 82040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttttgaatgttgttaca

SEQ ID NO: 82041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctttctttttgaatgttg

SEQ ID NO: 82042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcctttctttttgaatgtt

SEQ ID NO: 82043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcctttctttttgaatgt

SEQ ID NO: 82044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatctttgtcctttctttt

SEQ ID NO: 82045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatctttgtcctttcttt

SEQ ID NO: 82046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtatctttgtcctttctt

SEQ ID NO: 82047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagtatctttgtcctttct

SEQ ID NO: 82048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttagtatctttgtccttt

SEQ ID NO: 82049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttagtatctttgtcctt

SEQ ID NO: 82050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcttttagtatctttgtc

SEQ ID NO: 82051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaaataaatctatttctt

SEQ ID NO: 82052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctgataaaataaatctat

SEQ ID NO: 82053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaggctgataaaataaatc

SEQ ID NO: 82054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttattaggctgataaaata

SEQ ID NO: 82055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttattaggctgataaaat

SEQ ID NO: 82056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttattaggctgataaaa

SEQ ID NO: 82057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagttattaggctgataaa

SEQ ID NO: 82058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaagtaatacaaattttt

SEQ ID NO: 82059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataaagtaatacaaatttt

SEQ ID NO: 82060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtagtgtttcataaagtaa

SEQ ID NO: 82061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagtagtgtttcataaagt

SEQ ID NO: 82062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagtagtgtttcataaag

SEQ ID NO: 82063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaagtagtgtttcataaa

SEQ ID NO: 82064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaagtgttttctaagtag

SEQ ID NO: 82065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaagtgttttctaagta

SEQ ID NO: 82066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaagtgttttctaagt

SEQ ID NO: 82067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaagtgttttctaag

SEQ ID NO: 82068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaaagtgttttctaa

SEQ ID NO: 82069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaaaagtgttttcta

SEQ ID NO: 82070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaaaaagtgttttct

SEQ ID NO: 82071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaataaaatgaaattttttt

SEQ ID NO: 82072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagaaactcaaataaaatga

SEQ ID NO: 82073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaagaaactatagaaactc

SEQ ID NO: 82074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaattaagaagaaactata

SEQ ID NO: 82075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaagctccaaattaagaa

SEQ ID NO: 82076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaaagctccaaattaaga

SEQ ID NO: 82077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaaagctccaaattaag

SEQ ID NO: 82078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagattttacaaaagctcca

SEQ ID NO: 82079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatattaaagattttacaaa

SEQ ID NO: 82080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatcaaatggaaatcgagct

SEQ ID NO: 82081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattggatcaaatggaaatc

SEQ ID NO: 82082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattggatcaaatggaaat

SEQ ID NO: 82083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattggatcaaatggaaa

SEQ ID NO: 82084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttacattggatcaaatg

SEQ ID NO: 82085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcattttacattggatcaa

SEQ ID NO: 82086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcattttacattggatca

SEQ ID NO: 82087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcattttacattggatc

SEQ ID NO: 82088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaggattttattcattttac

SEQ ID NO: 82089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaaggattttattcattt

SEQ ID NO: 82090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgctgaaggattttattca

SEQ ID NO: 82091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taactgttgctgaaggattt

SEQ ID NO: 82092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgatatatattgtaactgt

SEQ ID NO: 82093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgatatatattgtaactg

SEQ ID NO: 82094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatggaatagaagtacactt

SEQ ID NO: 82095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatggaatagaagtacac

SEQ ID NO: 82096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctgtatggaatagaagta

SEQ ID NO: 82097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaccagtgtgaattgttct

SEQ ID NO: 82098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgagccactgaaaccagtgt

SEQ ID NO: 82099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acctgtgagccactgaaacc

SEQ ID NO: 82100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgacctgtgagccactgaa

SEQ ID NO: 82101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgggaaaggccaagatg

SEQ ID NO: 82102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgtggagcacaaattgt

SEQ ID NO: 82103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaatgtggagcacaaatt

SEQ ID NO: 82104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacagggtcaacagctctaa

SEQ ID NO: 82105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcatctccacagggtcaa

SEQ ID NO: 82106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagaggttatgtcatctcc

SEQ ID NO: 82107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctcagagaggttatgtca

SEQ ID NO: 82108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggctcagagaggttatgtc

SEQ ID NO: 82109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaatcttaggctcagagag

SEQ ID NO: 82110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactaggaatcttaggctc

SEQ ID NO: 82111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaactaggaatcttaggct

SEQ ID NO: 82112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaactaggaatcttaggc

SEQ ID NO: 82113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaactaggaatcttagg

SEQ ID NO: 82114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatttttcaaactaggaatc

SEQ ID NO: 82115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcaatttttcaaactagg

SEQ ID NO: 82116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaactcaatttttcaaact

SEQ ID NO: 82117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggagcatgattattaactca

SEQ ID NO: 82118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cggagcatgattattaactc

SEQ ID NO: 82119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcggagcatgattattaac

SEQ ID NO: 82120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaccactcttcggagcatga

SEQ ID NO: 82121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatcacaatctaaaccac

SEQ ID NO: 82122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacagttaaccatcacaa

SEQ ID NO: 82123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatacagttaaccatcaca

SEQ ID NO: 82124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatacagttaaccatcac

SEQ ID NO: 82125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcactttatatacagttaa

SEQ ID NO: 82126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaagcactttatatacagt

SEQ ID NO: 82127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgttaagcactttatatac

SEQ ID NO: 82128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgttaagcactttatata

SEQ ID NO: 82129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctgttaagcactttata

SEQ ID NO: 82130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgcaaaactcttcctgtt

SEQ ID NO: 82131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatgtgcaaaactcttcc

SEQ ID NO: 82132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgaatacgtgttcattat

SEQ ID NO: 82133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagctccatgaatacgtgt

SEQ ID NO: 82134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgagctccatgaatacgtg

SEQ ID NO: 82135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatcttatgagctccatg

SEQ ID NO: 82136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatagaaggatgagacaag

SEQ ID NO: 82137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaaagcaaggaattaaaa

SEQ ID NO: 82138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaagcatgataaaattat

SEQ ID NO: 82139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatggaagcatgataaaa

SEQ ID NO: 82140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattatggaagcatgataaa

SEQ ID NO: 82141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattatggaagcatgataa

SEQ ID NO: 82142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatattttaattatggaag

SEQ ID NO: 82143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atataattaatatattttaa

SEQ ID NO: 82144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatataattaatatatttta

SEQ ID NO: 82145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttaatataattaatatat

SEQ ID NO: 82146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccataaatggaaatatcctc

SEQ ID NO: 82147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaggccaatacattcccat

SEQ ID NO: 82148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaggccaatacattccca

SEQ ID NO: 82149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtttaaaaggccaataca

SEQ ID NO: 82150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtttaaaaggccaatac

SEQ ID NO: 82151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatgaaatgtttcatgttt

SEQ ID NO: 82152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgctcatatgaaatgttt

SEQ ID NO: 82153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattacatgctcatatgaa

SEQ ID NO: 82154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatattacatgctcatatga

SEQ ID NO: 82155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaatattacatgctcata

SEQ ID NO: 82156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtttaatattacatgctca

SEQ ID NO: 82157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatctctgtttaatattaca

SEQ ID NO: 82158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactaaatctctgtttaata

SEQ ID NO: 82159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaactaaatctctgtttaa

SEQ ID NO: 82160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctaaactaaatctctgtt

SEQ ID NO: 82161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actactctaaactaaatctc

SEQ ID NO: 82162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactcactactctaaactaa

SEQ ID NO: 82163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctagactcactactctaa

SEQ ID NO: 82164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcctagactcactactcta

SEQ ID NO: 82165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacttgtcctagactcacta

SEQ ID NO: 82166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgaacttgtcctagactca

SEQ ID NO: 82167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctcctgaacttgtcctaga

SEQ ID NO: 82168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagctcctgaacttgtccta

SEQ ID NO: 82169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagctcctgaacttgtcct

SEQ ID NO: 82170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctagctcctgaacttgtcc

SEQ ID NO: 82171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaacccaggctttctagct

SEQ ID NO: 82172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaagtagtgaatccagtat

SEQ ID NO: 82173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctagtaagtagtgaatcca

SEQ ID NO: 82174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctagtaagtagtgaatcc

SEQ ID NO: 82175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatgtccaagatcatttag

SEQ ID NO: 82176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgggatgtccaagatcat

SEQ ID NO: 82177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactgggatgtccaagatca

SEQ ID NO: 82178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttaactgggatgtccaaga

SEQ ID NO: 82179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatcagaaaagttgcttaa

SEQ ID NO: 82180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatcagaaaagttgctta

SEQ ID NO: 82181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaatcagaaaagttgctt

SEQ ID NO: 82182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagaatcagaaaagttgct

SEQ ID NO: 82183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacatttttagaatcagaaa

SEQ ID NO: 82184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgcctcaacatttttaga

SEQ ID NO: 82185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaataaataatgtcctaa

SEQ ID NO: 82186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaaataaataatgtccta

SEQ ID NO: 82187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaaataaataatgtcct

SEQ ID NO: 82188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattttacaaaataaataat

SEQ ID NO: 82189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattacattttacaaaata

SEQ ID NO: 82190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaattacattttacaaaat

SEQ ID NO: 82191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaaaattacattttacaa

SEQ ID NO: 82192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattgtttaaaattacattt

SEQ ID NO: 82193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtattgtttaaaattacatt

SEQ ID NO: 82194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtattgtttaaaattaca

SEQ ID NO: 82195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggatactcttgtattgttt

SEQ ID NO: 82196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggatactcttgtattgt

SEQ ID NO: 82197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaatcaacagtcattcta

SEQ ID NO: 82198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcaatcaacagtcattct

SEQ ID NO: 82199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagcaatcaacagtcattc

SEQ ID NO: 82200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtgacccaatcctttgag

SEQ ID NO: 82201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcagtgacccaatcctttg

SEQ ID NO: 82202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaggaaattctgcagtg

SEQ ID NO: 82203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaaaggaaattctgcagt

SEQ ID NO: 82204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagaaaggaaattctgca

SEQ ID NO: 82205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaagaaaggaaattctgc

SEQ ID NO: 82206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttaagaaaggaaattctg

SEQ ID NO: 82207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaacaacaaaggtgaaatg

SEQ ID NO: 82208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atataaagttcaaaacaaca

SEQ ID NO: 82209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catataaagttcaaaacaac

SEQ ID NO: 82210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagtcttcatataaagttc

SEQ ID NO: 82211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaagtcttcatataaagtt

SEQ ID NO: 82212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaagtcttcatataaagt

SEQ ID NO: 82213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaatattttgcaagtctt

SEQ ID NO: 82214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attaaaaaatattttgcaag

SEQ ID NO: 82215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctaattaaaaaatattttg

SEQ ID NO: 82216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctaattaaaaaatatttt

SEQ ID NO: 82217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtctaattaaaaaatattt

SEQ ID NO: 82218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agccacatgactttgtctaa

SEQ ID NO: 82219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagccacatgactttgtcta

SEQ ID NO: 82220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgagccacatgactttgtc

SEQ ID NO: 82221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatagttcttgagccaca

SEQ ID NO: 82222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgatagttcttgagccac

SEQ ID NO: 82223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgaataaaaaagaaaaaa

SEQ ID NO: 82224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcaatattcaatgaataaa

SEQ ID NO: 82225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagcaatattcaatgaat

SEQ ID NO: 82226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accctgttcagcaatattca

SEQ ID NO: 82227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaccctgttcagcaatattc

SEQ ID NO: 82228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaccctgttcagcaatatt

SEQ ID NO: 82229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaccctgttcagcaatat

SEQ ID NO: 82230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttttgaccctgttcagcaa

SEQ ID NO: 82231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttttgaccctgttcagca

SEQ ID NO: 82232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcttttgaccctgttca

SEQ ID NO: 82233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgcttttgaccctgttc

SEQ ID NO: 82234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatttatttgcttttgacc

SEQ ID NO: 82235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaagataaaccaagtgttg

SEQ ID NO: 82236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagaagataaaccaagtgt

SEQ ID NO: 82237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagaagataaaccaagtg

SEQ ID NO: 82238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtttctcagaagataaa

SEQ ID NO: 82239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtttctcagaagataa

SEQ ID NO: 82240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatatttaaatgtttctc

SEQ ID NO: 82241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattaatgatatttaaatgt

SEQ ID NO: 82242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagattacattaatgatat

SEQ ID NO: 82243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagagattacattaatga

SEQ ID NO: 82244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttcagagattacattaat

SEQ ID NO: 82245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattctgttcagagattaca

SEQ ID NO: 82246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtattctgttcagagattac

SEQ ID NO: 82247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtattctgttcagagatt

SEQ ID NO: 82248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggaagggatcattcttgt

SEQ ID NO: 82249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaggaagggatcattcttg

SEQ ID NO: 82250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgaaggaagggatcattc

SEQ ID NO: 82251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgaaggaagggatcatt

SEQ ID NO: 82252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcttgaaggaagggatcat

SEQ ID NO: 82253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgcttgaaggaagggatc

SEQ ID NO: 82254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgcttgaaggaagggat

SEQ ID NO: 82255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatatttctttgcttgaag

SEQ ID NO: 82256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagagactgtaatatttctt

SEQ ID NO: 82257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggagagactgtaatatttc

SEQ ID NO: 82258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaactctggagagactgtaa

SEQ ID NO: 82259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaactctggagagactgt

SEQ ID NO: 82260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagccataccaggcacaca

SEQ ID NO: 82261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaatagtatgttcagagcc

SEQ ID NO: 82262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaatagtatgttcagagc

SEQ ID NO: 82263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaaatagtatgttcagag

SEQ ID NO: 82264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaataccgttttccaaat

SEQ ID NO: 82265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagaataccgttttccaaa

SEQ ID NO: 82266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttcaagaataccgttttc

SEQ ID NO: 82267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacttcaagaataccgtttt

SEQ ID NO: 82268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatatttgacttcaagaat

SEQ ID NO: 82269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaatatttgacttcaagaa

SEQ ID NO: 82270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttccaatatttgacttcaa

SEQ ID NO: 82271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtctgcttccaatatttg

SEQ ID NO: 82272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatgtctgcttccaatat

SEQ ID NO: 82273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgatgtctgcttccaata

SEQ ID NO: 82274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgatgtctgcttccaat

SEQ ID NO: 82275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggatgaaaggaagtccccc

SEQ ID NO: 82276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggggatgaaaggaagtcccc

SEQ ID NO: 82277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtaccttggggatgaaa

SEQ ID NO: 82278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catagtaccttggggatgaa

SEQ ID NO: 82279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatagtaccttggggatga

SEQ ID NO: 82280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgaagggttttcatagta

SEQ ID NO: 82281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctatgtgaagggttttcat

SEQ ID NO: 82282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctatgtgaagggttttca

SEQ ID NO: 82283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctatgtgaagggttttc

SEQ ID NO: 82284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagattttccctatgtgaag

SEQ ID NO: 82285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcctatagattttccctat

SEQ ID NO: 82286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacctcatcctatagattt

SEQ ID NO: 82287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccacctcatcctatagatt

SEQ ID NO: 82288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggaaacccacttcccacct

SEQ ID NO: 82289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggaaacccacttcccacc

SEQ ID NO: 82290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaacacttagggaaaccca

SEQ ID NO: 82291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtgaacacttagggaaac

SEQ ID NO: 82292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtgaacacttagggaaa

SEQ ID NO: 82293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgtgaacacttagggaa

SEQ ID NO: 82294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgtgaacacttaggga

SEQ ID NO: 82295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatttttactgtgaacact

SEQ ID NO: 82296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatttttactgtgaacac

SEQ ID NO: 82297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggatttacaatttttact

SEQ ID NO: 82298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaggatttacaatttttac

SEQ ID NO: 82299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagaggatttacaattttta

SEQ ID NO: 82300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagaggatttacaattttt

SEQ ID NO: 82301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagaggatttacaatttt

SEQ ID NO: 82302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgattttttagaggattt

SEQ ID NO: 82303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtgattttttagaggatt

SEQ ID NO: 82304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcagtgattttttagagg

SEQ ID NO: 82305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttcagtgattttttagag

SEQ ID NO: 82306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtttacttcagtgatttt

SEQ ID NO: 82307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgttggtgtttacttcagt

SEQ ID NO: 82308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtaaaaattagtgttggtg

SEQ ID NO: 82309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaggtaaaaattagtgttg

SEQ ID NO: 82310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttattaggtaaaaattagt

SEQ ID NO: 82311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttattaggtaaaaattag

SEQ ID NO: 82312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttattaggtaaaaatta

SEQ ID NO: 82313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagttattaggtaaaaatt

SEQ ID NO: 82314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttagttattaggtaaaa

SEQ ID NO: 82315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttagttattaggtaaa

SEQ ID NO: 82316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttttagttattaggtaa

SEQ ID NO: 82317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccttttagttattaggta

SEQ ID NO: 82318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccttttagttattaggt

SEQ ID NO: 82319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acattttttccttttagtta

SEQ ID NO: 82320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atataatgggcacaactcac

SEQ ID NO: 82321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtctaatataatgggcac

SEQ ID NO: 82322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagtctaatataatgggca

SEQ ID NO: 82323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagtctaatataatgggc

SEQ ID NO: 82324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccagtctaatataatggg

SEQ ID NO: 82325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaccttttccagtctaata

SEQ ID NO: 82326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtggccaagaaggtaatag

SEQ ID NO: 82327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatgtggccaagaaggtaa

SEQ ID NO: 82328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtacctgttatgtggccaag

SEQ ID NO: 82329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtacctgttatgtggccaa

SEQ ID NO: 82330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagtatttagtacctgttat

SEQ ID NO: 82331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggagtatttagtacctgtta

SEQ ID NO: 82332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtttggagtatttagtac

SEQ ID NO: 82333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaactgcagtttggagtat

SEQ ID NO: 82334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaactgcagtttggagta

SEQ ID NO: 82335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaatcatttgggaactgc

SEQ ID NO: 82336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acactaataaatcatttggg

SEQ ID NO: 82337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgccctgacactaataaat

SEQ ID NO: 82338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agccacaatagaattggtgc

SEQ ID NO: 82339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgagccacaatagaattg

SEQ ID NO: 82340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taactgagccacaatagaat

SEQ ID NO: 82341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatggacataatatgcacat

SEQ ID NO: 82342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaattatatggacataat

SEQ ID NO: 82343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaagcacaacatattaca

SEQ ID NO: 82344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacaaaagcacaacatatt

SEQ ID NO: 82345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attattacaaaagcacaaca

SEQ ID NO: 82346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatataagataaacattaa

SEQ ID NO: 82347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatataagataaacatta

SEQ ID NO: 82348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatatataagataaacatt

SEQ ID NO: 82349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaatatagctttcatat

SEQ ID NO: 82350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaataaatatagctttcata

SEQ ID NO: 82351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaataaatatagctttca

SEQ ID NO: 82352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttaaataaatatagcttt

SEQ ID NO: 82353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctcttaaataaatatagc

SEQ ID NO: 82354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attctcttaaataaatatag

SEQ ID NO: 82355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagaataacttattctctt

SEQ ID NO: 82356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagaataacttattctct

SEQ ID NO: 82357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagagaataacttattctc

SEQ ID NO: 82358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagagaataacttattct

SEQ ID NO: 82359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggagatatttttaagagaat

SEQ ID NO: 82360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgggagatatttttaaga

SEQ ID NO: 82361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggaattatctgggagata

SEQ ID NO: 82362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggaattatctgggagat

SEQ ID NO: 82363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaaaggaattatctggga

SEQ ID NO: 82364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaggaaacatactgttt

SEQ ID NO: 82365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagagatgtcaaaagttat

SEQ ID NO: 82366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaagagatgtcaaaagtt

SEQ ID NO: 82367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacaagagatgtcaaaagt

SEQ ID NO: 82368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctacaagagatgtcaaaag

SEQ ID NO: 82369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttctacaagagatgtcaa

SEQ ID NO: 82370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctttctacaagagatgtca

SEQ ID NO: 82371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgctttctacaagagatg

SEQ ID NO: 82372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaaacaaacaagtaaaca

SEQ ID NO: 82373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcaagattaaagaaacaaa

SEQ ID NO: 82374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatcaagattaaagaaaca

SEQ ID NO: 82375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataagaaaatgtcatatc

SEQ ID NO: 82376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaataagaaaatgtcatat

SEQ ID NO: 82377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgaaataagaaaatgtca

SEQ ID NO: 82378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctccttgaaataagaaaatg

SEQ ID NO: 82379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctccttgaaataagaaa

SEQ ID NO: 82380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctccttgaaataagaa

SEQ ID NO: 82381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgctccttgaaataaga

SEQ ID NO: 82382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttcctgctccttgaaata

SEQ ID NO: 82383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagcgtgtagctattttcc

SEQ ID NO: 82384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataagaaaatatagagtt

SEQ ID NO: 82385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaataagaaaatatagagt

SEQ ID NO: 82386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgaaataagaaaatatag

SEQ ID NO: 82387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctccttgaaataagaaaata

SEQ ID NO: 82388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctccttgaaataagaaa

SEQ ID NO: 82389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgctccttgaaataagaa

SEQ ID NO: 82390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgctccttgaaataaga

SEQ ID NO: 82391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttcctgctccttgaaata

SEQ ID NO: 82392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagcatgtagctattttcc

SEQ ID NO: 82393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagagttgtgagcatgtagc

SEQ ID NO: 82394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatagagttgtgagcatgt

SEQ ID NO: 82395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattattatagagttgtga

SEQ ID NO: 82396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtgatggaatgcaaaacag

SEQ ID NO: 82397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggtaagaggctcagtgat

SEQ ID NO: 82398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaggtaagaggctcagtga

SEQ ID NO: 82399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttacaggtaagaggctcag

SEQ ID NO: 82400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttatttacaggtaagagg

SEQ ID NO: 82401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgaaataagattaagttat

SEQ ID NO: 82402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcgaaataagattaagtta

SEQ ID NO: 82403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcgaaataagattaagtt

SEQ ID NO: 82404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattttatcgaaataagat

SEQ ID NO: 82405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtaattttatcgaaataa

SEQ ID NO: 82406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgttgtaattttatcgaa

SEQ ID NO: 82407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaattgttgtaattttat

SEQ ID NO: 82408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caggcgcccacaccacacct

SEQ ID NO: 82409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agattgcaggcgcccacacc

SEQ ID NO: 82410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtagctgagattgcaggcg

SEQ ID NO: 82411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgagtagctgagattgcag

SEQ ID NO: 82412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcctgagtagctgaga

SEQ ID NO: 82413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcctgagtagct

SEQ ID NO: 82414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctcctgagta

SEQ ID NO: 82415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcctcctgag

SEQ ID NO: 82416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtaattctcctgcctcag

SEQ ID NO: 82417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttcaagtaattctcctgc

SEQ ID NO: 82418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgggttcaagtaattctcc

SEQ ID NO: 82419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgctgggttcaagtaatt

SEQ ID NO: 82420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcctgctgggttcaagtaa

SEQ ID NO: 82421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacctctgcctgctgggtt

SEQ ID NO: 82422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaacctctgcctgctg

SEQ ID NO: 82423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggctcactgcaacctctgcc

SEQ ID NO: 82424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtggcgcgatctc

SEQ ID NO: 82425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggctggagtgcagtggcgc

SEQ ID NO: 82426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttcaggctggagtgcagtg

SEQ ID NO: 82427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggttcaggctggagtgcag

SEQ ID NO: 82428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctggttcaggctggagtgc

SEQ ID NO: 82429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatggagtcccgctctctg

SEQ ID NO: 82430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatggagtcccgctctct

SEQ ID NO: 82431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgagatggagtcccgctc

SEQ ID NO: 82432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgagatggagtcccgct

SEQ ID NO: 82433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttgagatggagtccc

SEQ ID NO: 82434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttgagatggagtcc

SEQ ID NO: 82435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttatttgagatggag

SEQ ID NO: 82436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatttatttgagatgga

SEQ ID NO: 82437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaataaatttatttatt

SEQ ID NO: 82438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaataaataaatttatttat

SEQ ID NO: 82439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaataaataaatttattta

SEQ ID NO: 82440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaccaattttaaataaataa

SEQ ID NO: 82441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attggaccaattttaaataa

SEQ ID NO: 82442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaatgattaattggaccaa

SEQ ID NO: 82443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaatgattaattggacca

SEQ ID NO: 82444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcagatcttccaaatgatta

SEQ ID NO: 82445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcagatcttccaaatgatt

SEQ ID NO: 82446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcagatcttccaaatgat

SEQ ID NO: 82447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattttggcagatcttcca

SEQ ID NO: 82448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcagattttggcagatct

SEQ ID NO: 82449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatctcattcagattttggc

SEQ ID NO: 82450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actcaatctcattcagattt

SEQ ID NO: 82451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactgactcaatctcattca

SEQ ID NO: 82452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactgactcaatctcattc

SEQ ID NO: 82453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatttatactgactcaat

SEQ ID NO: 82454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatatttatactgactcaa

SEQ ID NO: 82455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttaaatatttatactgac

SEQ ID NO: 82456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccactgtcttaaatattta

SEQ ID NO: 82457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccactgtcttaaatattt

SEQ ID NO: 82458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttgtccactgtcttaaa

SEQ ID NO: 82459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatttgtccactgtcttaa

SEQ ID NO: 82460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacatttgtccactgtctta

SEQ ID NO: 82461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttacatttgtccactgt

SEQ ID NO: 82462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctttacatttgtccactg

SEQ ID NO: 82463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatctttacatttgtcca

SEQ ID NO: 82464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttatctttacatttgtcc

SEQ ID NO: 82465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttatctttacatttgtc

SEQ ID NO: 82466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttatctttacatttgt

SEQ ID NO: 82467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttatctttacatttg

SEQ ID NO: 82468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatcaataaaaatgtattt

SEQ ID NO: 82469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacagttagcatcaataaa

SEQ ID NO: 82470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaacagttagcatcaataa

SEQ ID NO: 82471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaacagttagcatcaata

SEQ ID NO: 82472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttacaacagttagcatc

SEQ ID NO: 82473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttacaacagttagcat

SEQ ID NO: 82474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagcagtatttcattttac

SEQ ID NO: 82475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaagcagtatttcatttta

SEQ ID NO: 82476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaagcagtatttcatttt

SEQ ID NO: 82477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagaagtgacattttcaaag

SEQ ID NO: 82478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagagaagtgacattttcaa

SEQ ID NO: 82479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagagaagtgacattttca

SEQ ID NO: 82480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtttctagagaagtgac

SEQ ID NO: 82481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caggaaaaaatcactatgtg

SEQ ID NO: 82482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgcaggaaaaaatcacta

SEQ ID NO: 82483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgcaggaaaaaatcact

SEQ ID NO: 82484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacctgcaggaaaaaatcac

SEQ ID NO: 82485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcaagattttacctgcag

SEQ ID NO: 82486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtcaagattttacctgca

SEQ ID NO: 82487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggtacttcagtcaagatt

SEQ ID NO: 82488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaattaatggtacttcagt

SEQ ID NO: 82489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaattaatggtacttcag

SEQ ID NO: 82490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaattaatggtacttca

SEQ ID NO: 82491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatgctttaaaaattaat

SEQ ID NO: 82492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagaatgctttaaaaattaa

SEQ ID NO: 82493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggtgccttgagaatgcttt

SEQ ID NO: 82494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatggtgccttgagaatgct

SEQ ID NO: 82495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attctatggtgccttgagaa

SEQ ID NO: 82496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgattctatggtgccttgag

SEQ ID NO: 82497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgttctgattctatggtgc

SEQ ID NO: 82498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatgttctgattctatggt

SEQ ID NO: 82499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggttctcatgttctgattct

SEQ ID NO: 82500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggttctcatgttctgattc

SEQ ID NO: 82501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggttctcatgttctgatt

SEQ ID NO: 82502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaggttctcatgttctgat

SEQ ID NO: 82503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaggttctcatgttctga

SEQ ID NO: 82504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaactttttaggttctc

SEQ ID NO: 82505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaataaactttttaggttct

SEQ ID NO: 82506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatttaaataaacttttta

SEQ ID NO: 82507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actatgatttaaataaactt

SEQ ID NO: 82508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttaactatgatttaaat

SEQ ID NO: 82509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgatgttaactatgattta

SEQ ID NO: 82510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgttgttgatgttaactat

SEQ ID NO: 82511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaatgagttatcgttgttg

SEQ ID NO: 82512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcacatagtatcaatggta

SEQ ID NO: 82513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatcacatagtatcaatgg

SEQ ID NO: 82514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaggaagatcacatatgt

SEQ ID NO: 82515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaaggaagatcacatatg

SEQ ID NO: 82516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggaaggaagatcacatat

SEQ ID NO: 82517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagttttgggaaggaagat

SEQ ID NO: 82518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggctataagttttgggaag

SEQ ID NO: 82519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattaaggctataagttttg

SEQ ID NO: 82520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atggttagattaaggctata

SEQ ID NO: 82521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatggttagattaaggcta

SEQ ID NO: 82522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatggttagattaaggct

SEQ ID NO: 82523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcatggttagattaaggc

SEQ ID NO: 82524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcatggttagattaagg

SEQ ID NO: 82525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatttttctcatggttaga

SEQ ID NO: 82526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgatatttttctcatggt

SEQ ID NO: 82527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctgatatttttctcatgg

SEQ ID NO: 82528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtatttgtctgatatttttc

SEQ ID NO: 82529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattggtatttgtctgatat

SEQ ID NO: 82530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaattggtatttgtctga

SEQ ID NO: 82531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaatgttcctgaattggt

SEQ ID NO: 82532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagaatgttcctgaattgg

SEQ ID NO: 82533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagaatgttcctgaattg

SEQ ID NO: 82534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtattttgtagaatgttcc

SEQ ID NO: 82535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgagtataggttaggtat

SEQ ID NO: 82536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtgagtataggttaggta

SEQ ID NO: 82537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagtgagtataggttaggt

SEQ ID NO: 82538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atactttgagtgagtatagg

SEQ ID NO: 82539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgatgttgatactttgagt

SEQ ID NO: 82540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgatgttgatactttgag

SEQ ID NO: 82541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatgatgttgatactttga

SEQ ID NO: 82542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatgatgttgatactttg

SEQ ID NO: 82543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttgatgatgttgatact

SEQ ID NO: 82544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttgatgatgttgatac

SEQ ID NO: 82545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtttttgatgatgttga

SEQ ID NO: 82546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgtttttgatgatgttg

SEQ ID NO: 82547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttgtttttgatgatgtt

SEQ ID NO: 82548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggctttccttgtttttgat

SEQ ID NO: 82549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaggctttccttgtttttg

SEQ ID NO: 82550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaggctttccttgttttt

SEQ ID NO: 82551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcgcaatttctcaggctttc

SEQ ID NO: 82552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctgtcgcaatttctcagg

SEQ ID NO: 82553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taggctgtcgcaatttctca

SEQ ID NO: 82554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcatctctaggctgtcgca

SEQ ID NO: 82555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagcatctctaggctgtcgc

SEQ ID NO: 82556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatcataccatcatatca

SEQ ID NO: 82557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccatcataccatcatatc

SEQ ID NO: 82558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttaaccatcataccatc

SEQ ID NO: 82559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccacattacatttaaccatc

SEQ ID NO: 82560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acccaggctaccacattaca

SEQ ID NO: 82561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagatctcacccaggctacc

SEQ ID NO: 82562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagatctcacccaggctac

SEQ ID NO: 82563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaagatctcacccaggcta

SEQ ID NO: 82564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcaagatctcacccaggc

SEQ ID NO: 82565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttcaagatctcacccag

SEQ ID NO: 82566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctttcaagatctcaccca

SEQ ID NO: 82567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctttcaagatctcaccc

SEQ ID NO: 82568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctctttcaagatctcacc

SEQ ID NO: 82569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctctttcaagatctcac

SEQ ID NO: 82570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttttctctttcaagatct

SEQ ID NO: 82571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttttctctttcaagatc

SEQ ID NO: 82572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttcctttttctctttcaa

SEQ ID NO: 82573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaatttcctttttctctt

SEQ ID NO: 82574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactaatttcctttttctct

SEQ ID NO: 82575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactaatttcctttttctc

SEQ ID NO: 82576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcactaatttcctttttct

SEQ ID NO: 82577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttttcactaatttccttt

SEQ ID NO: 82578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttttcactaatttcctt

SEQ ID NO: 82579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttagtttttcactaatttc

SEQ ID NO: 82580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagttccttagtttttcac

SEQ ID NO: 82581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcagagttccttagttttt

SEQ ID NO: 82582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctattcagagttccttag

SEQ ID NO: 82583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accctattcagagttcctta

SEQ ID NO: 82584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaatgcccttaccctatt

SEQ ID NO: 82585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaacaaatgcccttaccct

SEQ ID NO: 82586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattaacaaatgcccttac

SEQ ID NO: 82587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaaaccatgtgatacatc

SEQ ID NO: 82588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcacaattaacaaaaccatg

SEQ ID NO: 82589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcacaattaacaaaaccat

SEQ ID NO: 82590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatggcgcatttgtcacaa

SEQ ID NO: 82591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattagtatggcgcatttgt

SEQ ID NO: 82592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattagtatggcgcatttg

SEQ ID NO: 82593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagtttatattagtatggc

SEQ ID NO: 82594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaacagtttatattagtat

SEQ ID NO: 82595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttattaacagtttatattag

SEQ ID NO: 82596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctgttattaacagtttat

SEQ ID NO: 82597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccctgttattaacagttta

SEQ ID NO: 82598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatataccccacatccagtt

SEQ ID NO: 82599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatataccccacatccagt

SEQ ID NO: 82600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaaaaatggtgcagatag

SEQ ID NO: 82601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggaaaaatggtgcagata

SEQ ID NO: 82602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatagatttatggaaaaat

SEQ ID NO: 82603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaatagatttatggaaaaa

SEQ ID NO: 82604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttggaatagatttatgga

SEQ ID NO: 82605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttggaatagatttatgg

SEQ ID NO: 82606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttggaatagatttatg

SEQ ID NO: 82607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtcttggaatagatttat

SEQ ID NO: 82608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacttttgtcttggaataga

SEQ ID NO: 82609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacttttgtcttggaatag

SEQ ID NO: 82610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttaaacttttgtcttggaa

SEQ ID NO: 82611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttaaacttttgtcttgga

SEQ ID NO: 82612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttaaacttttgtcttgg

SEQ ID NO: 82613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcttaaacttttgtcttg

SEQ ID NO: 82614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttgcttaaacttttgtc

SEQ ID NO: 82615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttgcttaaacttttgt

SEQ ID NO: 82616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgatttccttttgcttaaac

SEQ ID NO: 82617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catctgtgatttccttttgc

SEQ ID NO: 82618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatctgtgatttcctttt

SEQ ID NO: 82619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataattctacatctgtga

SEQ ID NO: 82620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattagaataattctacat

SEQ ID NO: 82621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatattagaataattctaca

SEQ ID NO: 82622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatattagaataattct

SEQ ID NO: 82623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaatattagaataattc

SEQ ID NO: 82624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttaatattagaataatt

SEQ ID NO: 82625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctttatttaatattagaat

SEQ ID NO: 82626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacctttatttaatattag

SEQ ID NO: 82627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttattacctttatttaatat

SEQ ID NO: 82628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctattattacctttattt

SEQ ID NO: 82629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgagctattattaccttt

SEQ ID NO: 82630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattcactgagctattatt

SEQ ID NO: 82631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaattcaaattcactgag

SEQ ID NO: 82632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgataaattcaaattcac

SEQ ID NO: 82633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgataaattcaaattca

SEQ ID NO: 82634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagataatatagataatggc

SEQ ID NO: 82635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatattatagataatata

SEQ ID NO: 82636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtatattatagataatat

SEQ ID NO: 82637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacttaggtatattataga

SEQ ID NO: 82638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatcacttaggtatattat

SEQ ID NO: 82639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtctattatcacttaggta

SEQ ID NO: 82640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtctattatcacttaggt

SEQ ID NO: 82641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatttatgtctattatcac

SEQ ID NO: 82642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtggttcaaatttatgt

SEQ ID NO: 82643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaaagtggttcaaattt

SEQ ID NO: 82644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaaaagtggttcaaatt

SEQ ID NO: 82645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattaaaagtggttcaaat

SEQ ID NO: 82646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttaattaaaagtggttc

SEQ ID NO: 82647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattcattttaattaaaag

SEQ ID NO: 82648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgtaattcattttaatta

SEQ ID NO: 82649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtattaattgtaattcat

SEQ ID NO: 82650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgtattaattgtaattca

SEQ ID NO: 82651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgtattaattgtaattc

SEQ ID NO: 82652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgtattaattgtaatt

SEQ ID NO: 82653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtaaaatatgtatttttaa

SEQ ID NO: 82654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactgtgtaaaatatgtatt

SEQ ID NO: 82655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtactgtgtaaaatatgtat

SEQ ID NO: 82656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtactgtgtaaaatatgta

SEQ ID NO: 82657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttgtactgtgtaaaatat

SEQ ID NO: 82658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaaagcaatgctattttg

SEQ ID NO: 82659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgatcaaagcaatgctatt

SEQ ID NO: 82660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctattgatcaaagcaatgct

SEQ ID NO: 82661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggatctcctattgatcaa

SEQ ID NO: 82662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatggatctcctattgatc

SEQ ID NO: 82663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatggatctcctattgat

SEQ ID NO: 82664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcagcatttctaatggatc

SEQ ID NO: 82665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaactgatcagcatttc

SEQ ID NO: 82666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaaaactgatcagcattt

SEQ ID NO: 82667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagaaaactgatcagcatt

SEQ ID NO: 82668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttaagaaaactgatcagc

SEQ ID NO: 82669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggcatgattactttaag

SEQ ID NO: 82670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctcccaggcatgattact

SEQ ID NO: 82671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaaaattatcctcccagg

SEQ ID NO: 82672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagaaaattatcctcccag

SEQ ID NO: 82673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acccaggagagtgcatttat

SEQ ID NO: 82674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgacccaggagagtgcatt

SEQ ID NO: 82675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcctgacccaggagagtg

SEQ ID NO: 82676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtcataagctcattcct

SEQ ID NO: 82677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagtcataagctcattcc

SEQ ID NO: 82678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttataagtcataagctc

SEQ ID NO: 82679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtttataagtcataagc

SEQ ID NO: 82680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttctatgtttataagtcat

SEQ ID NO: 82681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttctatgtttataagtca

SEQ ID NO: 82682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtttagttctatgtttat

SEQ ID NO: 82683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgactccagtttagttctat

SEQ ID NO: 82684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agacattgtgactccagttt

SEQ ID NO: 82685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggactcagacattgtgactc

SEQ ID NO: 82686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtataattaggactcaga

SEQ ID NO: 82687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaagtataattaggactca

SEQ ID NO: 82688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataagacataatgactct

SEQ ID NO: 82689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttataataagacataatgac

SEQ ID NO: 82690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctattataataagacata

SEQ ID NO: 82691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcctattataataagacat

SEQ ID NO: 82692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcctattataataagaca

SEQ ID NO: 82693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagcctattataataagac

SEQ ID NO: 82694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagcctattataataaga

SEQ ID NO: 82695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttagcctattataataag

SEQ ID NO: 82696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataagtgtatttttttagcc

SEQ ID NO: 82697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcataagtgtattttttt

SEQ ID NO: 82698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagaaaatacacacagatt

SEQ ID NO: 82699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaagaaaatacacacaga

SEQ ID NO: 82700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctaaaagaaaatacacac

SEQ ID NO: 82701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attctaaaagaaaatacaca

SEQ ID NO: 82702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttattctaaaagaaaat

SEQ ID NO: 82703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtacttattctaaaag

SEQ ID NO: 82704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggagttaaattgtactta

SEQ ID NO: 82705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatggttgagggagttaaa

SEQ ID NO: 82706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accatggttgagggagttaa

SEQ ID NO: 82707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatgcttaccatggttgag

SEQ ID NO: 82708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatgcttaccatggttga

SEQ ID NO: 82709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagatatttagtatgctta

SEQ ID NO: 82710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaagatatttagtatgctt

SEQ ID NO: 82711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacttaaaagatatttag

SEQ ID NO: 82712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaacttaaaagatattta

SEQ ID NO: 82713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttaacaacttaaaagat

SEQ ID NO: 82714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatttaacaacttaaaaga

SEQ ID NO: 82715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatggatatgtaataaagc

SEQ ID NO: 82716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acggcatcattaagatggat

SEQ ID NO: 82717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacggcatcattaagatgga

SEQ ID NO: 82718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taccttaacggcatcattaa

SEQ ID NO: 82719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaccttaacggcatcatta

SEQ ID NO: 82720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaccttaacggcatcatt

SEQ ID NO: 82721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtaccttaacggcatcat

SEQ ID NO: 82722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtaacacagaaatcaaaa

SEQ ID NO: 82723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaagtaacacagaaatca

SEQ ID NO: 82724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acagttcctaaagtaacaca

SEQ ID NO: 82725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcacagttcctaaagtaa

SEQ ID NO: 82726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttacctcacagttcctaa

SEQ ID NO: 82727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgttacctcacagttcct

SEQ ID NO: 82728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctctatgttacctcacagt

SEQ ID NO: 82729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctctatgttacctcacag

SEQ ID NO: 82730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctctatgttacctcaca

SEQ ID NO: 82731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatctctatgttacctcac

SEQ ID NO: 82732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttatctctatgttacctc

SEQ ID NO: 82733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttatctctatgttacct

SEQ ID NO: 82734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagtcaaatacatttcttt

SEQ ID NO: 82735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtaaaatgagaatctcaga

SEQ ID NO: 82736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagctcagtaaaatgagaa

SEQ ID NO: 82737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaggtgttcagagctcagt

SEQ ID NO: 82738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgatgttatcaggtgttca

SEQ ID NO: 82739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgatgttatcaggtgtt

SEQ ID NO: 82740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctgatgatgttatcaggt

SEQ ID NO: 82741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctctgatgatgttatcagg

SEQ ID NO: 82742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttgctctgatgatgttat

SEQ ID NO: 82743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttgctctgatgatgtta

SEQ ID NO: 82744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttgctctgatgatgtt

SEQ ID NO: 82745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtcttgctctgatgatgt

SEQ ID NO: 82746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttttgtcttgctctgat

SEQ ID NO: 82747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagccagagtggagctgta

SEQ ID NO: 82748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcagccagagtggagctgt

SEQ ID NO: 82749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcgtatccttgtcagccag

SEQ ID NO: 82750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaccagggttaagcgtat

SEQ ID NO: 82751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttataaaccagggttaa

SEQ ID NO: 82752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagttataaaccagggtta

SEQ ID NO: 82753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagttataaaccagggtt

SEQ ID NO: 82754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtagttataaaccagggt

SEQ ID NO: 82755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaaaggggcttttgtagt

SEQ ID NO: 82756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgacaaaaggggcttttgt

SEQ ID NO: 82757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattattgacaaaaggg

SEQ ID NO: 82758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatattattgacaaaagg

SEQ ID NO: 82759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgaacataggagagtaatt

SEQ ID NO: 82760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaggtgatgttatcgaac

SEQ ID NO: 82761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagtagataagttatgaag

SEQ ID NO: 82762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttatgagtagataagtta

SEQ ID NO: 82763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgttatgagtagataagtt

SEQ ID NO: 82764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatgggaagtcttatgtta

SEQ ID NO: 82765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatgggaagtcttatgtt

SEQ ID NO: 82766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcatgggaagtcttatgt

SEQ ID NO: 82767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatcatgggaagtcttatg

SEQ ID NO: 82768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttatcatgggaagtctta

SEQ ID NO: 82769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttttatcatgggaagtct

SEQ ID NO: 82770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttttatcatgggaagtc

SEQ ID NO: 82771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgacatatttctcttttat

SEQ ID NO: 82772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgatgacatatttctcttt

SEQ ID NO: 82773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctgatgacatatttctct

SEQ ID NO: 82774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctctcctgatgacatatt

SEQ ID NO: 82775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatctctcctgatgacata

SEQ ID NO: 82776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcatctctcctgatgaca

SEQ ID NO: 82777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctctctcatctctcctgat

SEQ ID NO: 82778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaggaaacattgcctctct

SEQ ID NO: 82779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atactggaaggaaacattgc

SEQ ID NO: 82780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagagttcatactggaagg

SEQ ID NO: 82781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgggagaaggcctataaga

SEQ ID NO: 82782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgggagaaggcctataag

SEQ ID NO: 82783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgggagaaggcctataa

SEQ ID NO: 82784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttcatgggagaaggccta

SEQ ID NO: 82785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttcatgggagaaggcc

SEQ ID NO: 82786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgttttcatgggagaaggc

SEQ ID NO: 82787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgttttcatgggagaagg

SEQ ID NO: 82788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgttttcatgggagaag

SEQ ID NO: 82789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaatttttctgttttcatg

SEQ ID NO: 82790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatccatctggaaattttt

SEQ ID NO: 82791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagatccatctggaaatttt

SEQ ID NO: 82792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagatccatctggaaattt

SEQ ID NO: 82793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgccaagacatagaacaga

SEQ ID NO: 82794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtgccaagacatagaacag

SEQ ID NO: 82795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggtgccaagacatagaac

SEQ ID NO: 82796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggtgccaagacatagaa

SEQ ID NO: 82797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttggtgccaagacataga

SEQ ID NO: 82798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatattttcttggtgccaa

SEQ ID NO: 82799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcggaggccaggtgtagg

SEQ ID NO: 82800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaatcggaggccaggtgt

SEQ ID NO: 82801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcaatcggaggccaggtg

SEQ ID NO: 82802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttattcaatcggaggcca

SEQ ID NO: 82803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttattcaatcggaggcc

SEQ ID NO: 82804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatttcacttattcaatcg

SEQ ID NO: 82805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatatttcacttattcaatc

SEQ ID NO: 82806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttgatatttcacttattc

SEQ ID NO: 82807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatcttgatatttcactta

SEQ ID NO: 82808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatcttgatatttcactt

SEQ ID NO: 82809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattatcttgatatttcact

SEQ ID NO: 82810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattatcttgatatttcac

SEQ ID NO: 82811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatatagaatttttattat

SEQ ID NO: 82812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgacatatagaatttttat

SEQ ID NO: 82813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttattgacatatagaatttt

SEQ ID NO: 82814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttattgacatatagaattt

SEQ ID NO: 82815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttgttattgacatataga

SEQ ID NO: 82816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttgttattgacatatag

SEQ ID NO: 82817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatcttgttattgacatata

SEQ ID NO: 82818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctttatcttgttattgac

SEQ ID NO: 82819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagctttatcttgttattga

SEQ ID NO: 82820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtttcagctttatcttg

SEQ ID NO: 82821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatgtttcagctttatctt

SEQ ID NO: 82822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaatgtttcagctttatct

SEQ ID NO: 82823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttgaatgtttcagcttt

SEQ ID NO: 82824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtctttgaatgtttcagc

SEQ ID NO: 82825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgtctttgaatgtttcag

SEQ ID NO: 82826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattgtctttgaatgtttc

SEQ ID NO: 82827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttattgtctttgaatgttt

SEQ ID NO: 82828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttcttattgtctttgaa

SEQ ID NO: 82829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattgtacttcttattgtct

SEQ ID NO: 82830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgactaaattgtacttct

SEQ ID NO: 82831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcaatgactaaattgtact

SEQ ID NO: 82832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagagctattcaatgactaa

SEQ ID NO: 82833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactgtagagctattcaatg

SEQ ID NO: 82834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaaactgtagagctattc

SEQ ID NO: 82835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctaaactgtagagctatt

SEQ ID NO: 82836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatctaaactgtagagcta

SEQ ID NO: 82837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttatctaaactgtagagct

SEQ ID NO: 82838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttatctaaactgtagagc

SEQ ID NO: 82839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttcttatctaaactgta

SEQ ID NO: 82840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactttcttatctaaactgt

SEQ ID NO: 82841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgactttcttatctaaactg

SEQ ID NO: 82842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gcacctttgactttcttatc

SEQ ID NO: 82843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgcacctttgactttcttat

SEQ ID NO: 82844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcgtttcgcacctttgac

SEQ ID NO: 82845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagattcaatcgtttcgcac

SEQ ID NO: 82846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagattcaatcgtttcgc

SEQ ID NO: 82847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattctccagattcaatcgt

SEQ ID NO: 82848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctgtattctccagattca

SEQ ID NO: 82849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccctgtattctccagattc

SEQ ID NO: 82850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccctgtattctccagatt

SEQ ID NO: 82851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccctgtattctccagat

SEQ ID NO: 82852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcccctgtattctcca

SEQ ID NO: 82853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtattatttttcccctgta

SEQ ID NO: 82854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtattatttttcccctgt

SEQ ID NO: 82855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttaagtattatttttccc

SEQ ID NO: 82856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtttaagtattatttttcc

SEQ ID NO: 82857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggagcacataggaatgga

SEQ ID NO: 82858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattcaaggagcacatagg

SEQ ID NO: 82859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataattcaaggagcacatag

SEQ ID NO: 82860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatacccttataattcaag

SEQ ID NO: 82861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaaatgagaaatactgag

SEQ ID NO: 82862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattagtaaaatgagaaata

SEQ ID NO: 82863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agattagtaaaatgagaaat

SEQ ID NO: 82864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaggtatttagattagtaa

SEQ ID NO: 82865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaagatgttatcaggtatt

SEQ ID NO: 82866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccaaagatgttatcaggt

SEQ ID NO: 82867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctccaaagatgttatcagg

SEQ ID NO: 82868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcctccaaagatgttatc

SEQ ID NO: 82869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttcctccaaagatgttat

SEQ ID NO: 82870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttccttcctccaaagatgt

SEQ ID NO: 82871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctatttccttcctccaaag

SEQ ID NO: 82872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtagagctgtctatttcc

SEQ ID NO: 82873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagctagggtagagctgtc

SEQ ID NO: 82874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtgtaaccctgacagct

SEQ ID NO: 82875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagtgtaaccctgacagc

SEQ ID NO: 82876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcaaatttataagtgtaa

SEQ ID NO: 82877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaaggattgaatcaaattt

SEQ ID NO: 82878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagacatcctgccaaggatt

SEQ ID NO: 82879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacataaatgctgtagaca

SEQ ID NO: 82880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaacataaatgctgtagac

SEQ ID NO: 82881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttggaacataaatgctgt

SEQ ID NO: 82882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acacaaaatcctggcttgga

SEQ ID NO: 82883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacacaaaatcctggcttgg

SEQ ID NO: 82884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgacacaaaatcctggctt

SEQ ID NO: 82885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttgacacaaaatcctgg

SEQ ID NO: 82886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttgacacaaaatcctg

SEQ ID NO: 82887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtagcatttattcttgaca

SEQ ID NO: 82888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttgtgtagcatttattct

SEQ ID NO: 82889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgttgtgtagcatttatt

SEQ ID NO: 82890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtgttgtgtagcatttat

SEQ ID NO: 82891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtgttgtgtagcattta

SEQ ID NO: 82892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattttctgtgttgtgtag

SEQ ID NO: 82893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtattttctgtgttgtgta

SEQ ID NO: 82894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttggtattttctgtgttg

SEQ ID NO: 82895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtcttggtattttctgtg

SEQ ID NO: 82896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgctgtcttggtattttct

SEQ ID NO: 82897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaacagtccaaggtcattcc

SEQ ID NO: 82898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctagaacagtccaaggtca

SEQ ID NO: 82899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctagaacagtccaaggtc

SEQ ID NO: 82900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcttgcctagaacagtcca

SEQ ID NO: 82901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatggtaagatcatcatata

SEQ ID NO: 82902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaatggtaagatcatcata

SEQ ID NO: 82903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaggatctctcaatggtaa

SEQ ID NO: 82904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccaaggatctctcaatggt

SEQ ID NO: 82905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccaaggatctctcaatgg

SEQ ID NO: 82906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctccaaggatctctcaa

SEQ ID NO: 82907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctatttctccaaggatctc

SEQ ID NO: 82908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctatttctccaaggatct

SEQ ID NO: 82909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttggctatttctccaagga

SEQ ID NO: 82910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtcctatttggctatttct

SEQ ID NO: 82911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggtcctatttggctatttc

SEQ ID NO: 82912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaggtggtgccaggacctt

SEQ ID NO: 82913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaaaaaagaaaagtatta

SEQ ID NO: 82914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcataaaaaaagaaaagtat

SEQ ID NO: 82915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatgctctcataaaaaaag

SEQ ID NO: 82916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctaatatgctctcataaa

SEQ ID NO: 82917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaagaatagtcagtagga

SEQ ID NO: 82918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gataaagaatagtcagtagg

SEQ ID NO: 82919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgataaagaatagtcagtag

SEQ ID NO: 82920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgataaagaatagtcag

SEQ ID NO: 82921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttgataaagaatagtca

SEQ ID NO: 82922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggcttactttgataaagaa

SEQ ID NO: 82923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaataactatggcttactt

SEQ ID NO: 82924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaagttcacaataacta

SEQ ID NO: 82925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaaagttcacaataact

SEQ ID NO: 82926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagaaaagttcacaataac

SEQ ID NO: 82927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcagccacaaaatctttca

SEQ ID NO: 82928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgtgcagccacaaaatctt

SEQ ID NO: 82929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagcactgttgtgcagccac

SEQ ID NO: 82930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctacagcactgttgtgcagc

SEQ ID NO: 82931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actacagcactgttgtgcag

SEQ ID NO: 82932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttactacagcactgttgtg

SEQ ID NO: 82933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatatgacatctgcttact

SEQ ID NO: 82934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgattaatatatgacatct

SEQ ID NO: 82935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaacactagtgattaatat

SEQ ID NO: 82936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaacactagtgattaata

SEQ ID NO: 82937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcaaagtgcaggatttcca

SEQ ID NO: 82938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagcaaagtgcaggatttcc

SEQ ID NO: 82939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaagcaaagtgcaggatt

SEQ ID NO: 82940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggatgttatttaagcaaagt

SEQ ID NO: 82941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctaggatgttatttaagca

SEQ ID NO: 82942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caagactccctaggatgtta

SEQ ID NO: 82943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagctccaagactccctagg

SEQ ID NO: 82944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaagctccaagactcccta

SEQ ID NO: 82945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgttctcaagctccaaga

SEQ ID NO: 82946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgaatgttctcaagctcc

SEQ ID NO: 82947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatctgaatgttctcaag

SEQ ID NO: 82948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttatctgaatgttctcaa

SEQ ID NO: 82949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagttatctgaatgttctca

SEQ ID NO: 82950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtcaagaacctttagtta

SEQ ID NO: 82951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcctgaagtcaagaacctt

SEQ ID NO: 82952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagcctgaagtcaagaacct

SEQ ID NO: 82953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagataacccatagtggtcc

SEQ ID NO: 82954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagataacccatagtggtc

SEQ ID NO: 82955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacaatatttgaagataacc

SEQ ID NO: 82956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatgctaaacaatatttga

SEQ ID NO: 82957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgcaatgctaaacaatat

SEQ ID NO: 82958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgcaatgctaaacaata

SEQ ID NO: 82959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattgcaatgctaaacaat

SEQ ID NO: 82960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattttaattgcaatgctaa

SEQ ID NO: 82961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgaattttaattgcaatg

SEQ ID NO: 82962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgaattttaattgcaat

SEQ ID NO: 82963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattgaattttaattgcaa

SEQ ID NO: 82964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagacctttcattgaattt

SEQ ID NO: 82965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagacctttcattgaatt

SEQ ID NO: 82966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaaggggtttcacagacct

SEQ ID NO: 82967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaaggggtttcacagacc

SEQ ID NO: 82968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcaaggggtttcacagac

SEQ ID NO: 82969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagacagaaaatgaaaagtt

SEQ ID NO: 82970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaagacagaaaatgaaaag

SEQ ID NO: 82971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaataagacagaaattc

SEQ ID NO: 82972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaaaataagacagaaatt

SEQ ID NO: 82973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcaaaataagacagaaat

SEQ ID NO: 82974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcaaaataagacagaaa

SEQ ID NO: 82975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttatcaaaataagacag

SEQ ID NO: 82976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttatcaaaataagaca

SEQ ID NO: 82977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttatttttatcaaaata

SEQ ID NO: 82978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatattgtgtttatttttat

SEQ ID NO: 82979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtataaacgcaatattaa

SEQ ID NO: 82980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtggtataaacgcaatatt

SEQ ID NO: 82981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtggtataaacgcaatat

SEQ ID NO: 82982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttctgtggtataaacgcaa

SEQ ID NO: 82983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctccttctgtggtataaac

SEQ ID NO: 82984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagctgcctccttctgtggt

SEQ ID NO: 82985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccatattacagctgcctcc

SEQ ID NO: 82986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcccatattacagctgcct

SEQ ID NO: 82987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcccatattacagctgcc

SEQ ID NO: 82988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgcccatattacagctgc

SEQ ID NO: 82989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atactttctgcccatattac

SEQ ID NO: 82990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactcatactttctgcccat

SEQ ID NO: 82991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaactcatactttctgccca

SEQ ID NO: 82992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaatttaaactcatactt

SEQ ID NO: 82993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaaatttaaactcatact

SEQ ID NO: 82994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaaaatttaaactcatac

SEQ ID NO: 82995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacctttcaaaaatttaaac

SEQ ID NO: 82996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacctttcaaaaatttaaa

SEQ ID NO: 82997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagaaaatttatacctttc

SEQ ID NO: 82998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagaaaatttataccttt

SEQ ID NO: 82999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttataagaaaatttata

SEQ ID NO: 83000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtttataagaaaatttat

SEQ ID NO: 83001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaacagagtgagtgagac

SEQ ID NO: 83002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacctgggcaacagagtga

SEQ ID NO: 83003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactgcaacctgggcaacag

SEQ ID NO: 83004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtgagccgtgatcacagt

SEQ ID NO: 83005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtgcacgaggatgatgctc

SEQ ID NO: 83006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtgcacgaggatgatgct

SEQ ID NO: 83007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaggtgggaggtcgcttg

SEQ ID NO: 83008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaaggtgggaggtcgctt

SEQ ID NO: 83009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgggaaggtgggaggtcg

SEQ ID NO: 83010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtcccagctacttgggaa

SEQ ID NO: 83011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcccagcatggtggcacgca

SEQ ID NO: 83012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattagcccagcatggt

SEQ ID NO: 83013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaattagcccagcatgg

SEQ ID NO: 83014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaaattagcccagcatg

SEQ ID NO: 83015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaaaatgctttaaaaaat

SEQ ID NO: 83016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacaaaaaatgctttaaaaa

SEQ ID NO: 83017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctctacaaaaaatgcttta

SEQ ID NO: 83018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtctctacaaaaaatgcttt

SEQ ID NO: 83019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaacatggtgagaccttg

SEQ ID NO: 83020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagacgagcctgggcaacat

SEQ ID NO: 83021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcccaggagttcaagacga

SEQ ID NO: 83022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcccaggagttcaagacg

SEQ ID NO: 83023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccaaggagggcagat

SEQ ID NO: 83024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccaaggagggcaga

SEQ ID NO: 83025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggccaaggagggcag

SEQ ID NO: 83026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaccccagcactttgggag

SEQ ID NO: 83027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgcctgtaaccccagcact

SEQ ID NO: 83028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtggttgatgcctgtaacc

SEQ ID NO: 83029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgccaggctcagtggttgat

SEQ ID NO: 83030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattgtgccaggctcag

SEQ ID NO: 83031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaattgtgccaggctca

SEQ ID NO: 83032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaatttaaaaaattgtgcc

SEQ ID NO: 83033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggggaagagtaagataaaac

SEQ ID NO: 83034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactaggggaagagtaagat

SEQ ID NO: 83035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatctagactaggggaagag

SEQ ID NO: 83036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaatctagactaggggaa

SEQ ID NO: 83037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgaatctagactagggga

SEQ ID NO: 83038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgaatctagactagggg

SEQ ID NO: 83039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgaatctagactaggg

SEQ ID NO: 83040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttactgaatctagacta

SEQ ID NO: 83041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaccattgtttttactgaa

SEQ ID NO: 83042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatataataaattacaacca

SEQ ID NO: 83043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatccctaaatataataaa

SEQ ID NO: 83044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtaacaaataatatggtc

SEQ ID NO: 83045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caggtaacaaataatatggt

SEQ ID NO: 83046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttcaggtaacaaataa

SEQ ID NO: 83047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatttcaggtaacaaata

SEQ ID NO: 83048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatttcaggtaacaaat

SEQ ID NO: 83049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaatttcaggtaacaaa

SEQ ID NO: 83050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttaaaatttcaggtaa

SEQ ID NO: 83051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaatttttaaaatttcag

SEQ ID NO: 83052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttaatttttaaaatttca

SEQ ID NO: 83053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgtatagatttggttaat

SEQ ID NO: 83054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtgtatagatttggttaa

SEQ ID NO: 83055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttaagtgtatagatttggt

SEQ ID NO: 83056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacttaagtgtatagatttg

SEQ ID NO: 83057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctacttaagtgtatagat

SEQ ID NO: 83058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actctacttaagtgtataga

SEQ ID NO: 83059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactctacttaagtgtatag

SEQ ID NO: 83060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactctacttaagtgtata

SEQ ID NO: 83061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtgtttttactctactta

SEQ ID NO: 83062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattccagtgtttttactct

SEQ ID NO: 83063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctcaattccagtgttttta

SEQ ID NO: 83064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataatggctggctcaattcc

SEQ ID NO: 83065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatagattcataatggctgg

SEQ ID NO: 83066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtgaggaaagaggattgt

SEQ ID NO: 83067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtgttgtagtgaggaaag

SEQ ID NO: 83068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagcaaattgaggtgttgt

SEQ ID NO: 83069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagttaaaagcaaattga

SEQ ID NO: 83070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaagattataaagttaa

SEQ ID NO: 83071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataagattataaaaagatta

SEQ ID NO: 83072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taataagattataaaaagat

SEQ ID NO: 83073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaataagattataaaaaga

SEQ ID NO: 83074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctaataagattataaaa

SEQ ID NO: 83075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctaataagattataaa

SEQ ID NO: 83076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatttctaataagattat

SEQ ID NO: 83077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actgtttatttctaataaga

SEQ ID NO: 83078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactgtttatttctaataag

SEQ ID NO: 83079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgactgtttatttcta

SEQ ID NO: 83080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattatatttgactgtttat

SEQ ID NO: 83081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataagattatattatatttg

SEQ ID NO: 83082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagtgaagatgggcagtca

SEQ ID NO: 83083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacaaattcatagtgaagat

SEQ ID NO: 83084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaaatggcctggacaaat

SEQ ID NO: 83085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgaaatggcctggacaaa

SEQ ID NO: 83086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgaaatggcctggacaa

SEQ ID NO: 83087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagtgaaatggcctggaca

SEQ ID NO: 83088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcttttagtgaaatggcct

SEQ ID NO: 83089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgctagtcttttagtgaaa

SEQ ID NO: 83090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctcatgctagtcttttagt

SEQ ID NO: 83091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctggctcatgctagtctt

SEQ ID NO: 83092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggagagttatcctggctca

SEQ ID NO: 83093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggtctggggagagttatc

SEQ ID NO: 83094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagggctagaggtctgggg

SEQ ID NO: 83095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagttatcagggctagagg

SEQ ID NO: 83096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatcaatgagatgtgaagg

SEQ ID NO: 83097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtatcaatgagatgtgaag

SEQ ID NO: 83098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttagtatcaatgagatgtg

SEQ ID NO: 83099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaaagctccttagtatca

SEQ ID NO: 83100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagagaaagctccttagta

SEQ ID NO: 83101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttagagaaagctccttagt

SEQ ID NO: 83102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaccttgttagagaaagct

SEQ ID NO: 83103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacacagatgagtgtacct

SEQ ID NO: 83104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtgacacagatgagtg

SEQ ID NO: 83105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggacaatagttaaattgt

SEQ ID NO: 83106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtattcatggacaatagtt

SEQ ID NO: 83107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgaagctgtgtattcatg

SEQ ID NO: 83108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaaatgaagctgtgtatt

SEQ ID NO: 83109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attagttaaatgaagctgtg

SEQ ID NO: 83110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaattagttaaatgaagct

SEQ ID NO: 83111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactaattagttaaatgaag

SEQ ID NO: 83112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaggtacataaaattctac

SEQ ID NO: 83113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagttcccaggtacataaa

SEQ ID NO: 83114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaagttcccaggtacataa

SEQ ID NO: 83115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaaaagttcccaggtacat

SEQ ID NO: 83116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atactcttaaaagttcccag

SEQ ID NO: 83117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catactcttaaaagttccca

SEQ ID NO: 83118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggatttcatactcttaaa

SEQ ID NO: 83119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaggatttcatactcttaa

SEQ ID NO: 83120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgtaggatttcatactct

SEQ ID NO: 83121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagatacactgcttgtagga

SEQ ID NO: 83122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggctaaagatacactgct

SEQ ID NO: 83123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagcaatgttacaggctaa

SEQ ID NO: 83124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttccaagcaatgttacaggc

SEQ ID NO: 83125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttccaagcaatgttacagg

SEQ ID NO: 83126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttccaagcaatgttacag

SEQ ID NO: 83127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttgttccaagcaatgtta

SEQ ID NO: 83128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaaccaaatgacaggtct

SEQ ID NO: 83129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaggctacaaaaccaaat

SEQ ID NO: 83130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagagtgtcagggactacaa

SEQ ID NO: 83131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgttccagagtgtcaggga

SEQ ID NO: 83132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatgttccagagtgtcagg

SEQ ID NO: 83133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctaatgttccagagtgtca

SEQ ID NO: 83134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctaatgttccagagtgt

SEQ ID NO: 83135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctctctaatgttccaga

SEQ ID NO: 83136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactctctctaatgttccag

SEQ ID NO: 83137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactctctctaatgttcca

SEQ ID NO: 83138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaataatattttcactctct

SEQ ID NO: 83139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagaataatattttcactct

SEQ ID NO: 83140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctagaataatattttca

SEQ ID NO: 83141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactctagaataatattttc

SEQ ID NO: 83142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcactctagaataatatt

SEQ ID NO: 83143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatgaaaacacagaattcc

SEQ ID NO: 83144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaacgaaacaaaccatgt

SEQ ID NO: 83145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacaaacgaaacaaaccatg

SEQ ID NO: 83146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcacaaacgaaacaaacca

SEQ ID NO: 83147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaattcttcacaaacgaa

SEQ ID NO: 83148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgaattcttcacaaacga

SEQ ID NO: 83149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatatagtttgatgaatt

SEQ ID NO: 83150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaatgcatatatcc

SEQ ID NO: 83151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataaaagttaaaaaaaaa

SEQ ID NO: 83152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaataaaagttaaaaaaaa

SEQ ID NO: 83153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacttaaaataaaagttaaa

SEQ ID NO: 83154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgaacttaaaataaaagtt

SEQ ID NO: 83155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactcctgaacttaaaataa

SEQ ID NO: 83156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtactcctgaacttaaaata

SEQ ID NO: 83157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacttgtactcctgaactta

SEQ ID NO: 83158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtaacaaacctggacttgt

SEQ ID NO: 83159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctatgtaacaaacctggac

SEQ ID NO: 83160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctatgtaacaaacctgga

SEQ ID NO: 83161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaacaaacccccatgaca

SEQ ID NO: 83162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgatgaaataagctgtaa

SEQ ID NO: 83163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atacctgggtgatgaaataa

SEQ ID NO: 83164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtctaatacctgggtgatg

SEQ ID NO: 83165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatacagtagagggtggga

SEQ ID NO: 83166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatacagtagagggtggg

SEQ ID NO: 83167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaatacagtagagggtgg

SEQ ID NO: 83168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacctttcaaatacagtag

SEQ ID NO: 83169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtgagacacatagaggg

SEQ ID NO: 83170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataagtgagacacatagagg

SEQ ID NO: 83171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gcttataagtgagacacata

SEQ ID NO: 83172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcgcttataagtgagacaca

SEQ ID NO: 83173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaaaatgcatatatcat

SEQ ID NO: 83174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaataaaaatgcatatatca

SEQ ID NO: 83175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtataacatacttaaataa

SEQ ID NO: 83176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaagtataacatacttaa

SEQ ID NO: 83177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattaagtataacatactta

SEQ ID NO: 83178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattaagtataacatactt

SEQ ID NO: 83179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcattaagtataacatact

SEQ ID NO: 83180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttttcattaagtataaca

SEQ ID NO: 83181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacttttcattaagtataac

SEQ ID NO: 83182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacttttcattaagtataa

SEQ ID NO: 83183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacttttcattaagtata

SEQ ID NO: 83184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaacttttcattaagtat

SEQ ID NO: 83185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctttttaacttttcatta

SEQ ID NO: 83186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgttcatctttttaactttt

SEQ ID NO: 83187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgttcatctttttaacttt

SEQ ID NO: 83188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacgttcatctttttaactt

SEQ ID NO: 83189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacattttacgttcatct

SEQ ID NO: 83190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaacattttacgttcatc

SEQ ID NO: 83191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaacattttacgttcat

SEQ ID NO: 83192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaacattttacgttca

SEQ ID NO: 83193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaaagaagtttttaaaa

SEQ ID NO: 83194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaaaagaagtttttaaa

SEQ ID NO: 83195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaaaaagaagtttttaa

SEQ ID NO: 83196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttttcagaaaaagaagtt

SEQ ID NO: 83197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagttttcagaaaaagaagt

SEQ ID NO: 83198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacttgagttttcagaaaaa

SEQ ID NO: 83199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaacttgagttttcagaaa

SEQ ID NO: 83200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcaacttgagttttcaga

SEQ ID NO: 83201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attctctcaacttgagtttt

SEQ ID NO: 83202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtacaatgattaattctctc

SEQ ID NO: 83203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtacaatgattaattctct

SEQ ID NO: 83204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtacaatgattaattctc

SEQ ID NO: 83205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtatattttagtacaatg

SEQ ID NO: 83206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtatattttagtacaat

SEQ ID NO: 83207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtgtatattttagtacaa

SEQ ID NO: 83208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttagtgtatattttagta

SEQ ID NO: 83209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttagtgtatattttagt

SEQ ID NO: 83210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtacttcctttagtgtat

SEQ ID NO: 83211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctaaagtacttcctttagt

SEQ ID NO: 83212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcctaaagtacttccttta

SEQ ID NO: 83213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcctaaagtacttccttt

SEQ ID NO: 83214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctgcctaaagtacttcc

SEQ ID NO: 83215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctgcctaaagtacttc

SEQ ID NO: 83216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttctgcctaaagtactt

SEQ ID NO: 83217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccttctgcctaaagtact

SEQ ID NO: 83218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agatcttttccttctgccta

SEQ ID NO: 83219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctaagatcttttccttctg

SEQ ID NO: 83220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctaagatcttttccttct

SEQ ID NO: 83221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtctaagatcttttccttc

SEQ ID NO: 83222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtctaagatcttttcctt

SEQ ID NO: 83223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtctaagatcttttcct

SEQ ID NO: 83224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgtctaagatcttttc

SEQ ID NO: 83225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattctttttgtctaagatc

SEQ ID NO: 83226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccattctttttgtctaagat

SEQ ID NO: 83227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtttccattctttttgtct

SEQ ID NO: 83228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtgtttccattctttttg

SEQ ID NO: 83229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgtgtttccattcttttt

SEQ ID NO: 83230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctgtgtttccattcttt

SEQ ID NO: 83231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgctgtgtttccattctt

SEQ ID NO: 83232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcttgctgtgtttccat

SEQ ID NO: 83233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttcttgctgtgtttcca

SEQ ID NO: 83234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcatttcttgctgtgtttc

SEQ ID NO: 83235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atattcttcatttcttgctg

SEQ ID NO: 83236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatattcttcatttcttgc

SEQ ID NO: 83237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctaatattcttcatttct

SEQ ID NO: 83238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgtaaacaggcgcctatt

SEQ ID NO: 83239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatgtaaacaggcgcctat

SEQ ID NO: 83240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttacatgtaaacaggcgcc

SEQ ID NO: 83241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttacatgtaaacaggcgc

SEQ ID NO: 83242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttacatgtaaacaggcg

SEQ ID NO: 83243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccttacatgtaaacaggc

SEQ ID NO: 83244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagagtccatttttccttac

SEQ ID NO: 83245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagagtccatttttcctta

SEQ ID NO: 83246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtagagtccatttttcctt

SEQ ID NO: 83247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctttgtagagtccatttt

SEQ ID NO: 83248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctttgtagagtccattt

SEQ ID NO: 83249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctttgtagagtccatt

SEQ ID NO: 83250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcacctttgtagagtccat

SEQ ID NO: 83251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtagtcatttttcaccttt

SEQ ID NO: 83252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtagtcatttttcacctt

SEQ ID NO: 83253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtagtcatttttcacct

SEQ ID NO: 83254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgtgtagtcatttttca

SEQ ID NO: 83255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgctttgtgtagtcatttt

SEQ ID NO: 83256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgctttgtgtagtcattt

SEQ ID NO: 83257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaccataaaacataaacc

SEQ ID NO: 83258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaccataaaacataaac

SEQ ID NO: 83259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaaccataaaacataaa

SEQ ID NO: 83260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatagttttgaaaaccataa

SEQ ID NO: 83261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctatatagttttgaaaac

SEQ ID NO: 83262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctatatagttttgaaaa

SEQ ID NO: 83263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacctatatagttttgaaa

SEQ ID NO: 83264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcattttaacctatatag

SEQ ID NO: 83265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgcattttaacctatata

SEQ ID NO: 83266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacttaatgcattttaacct

SEQ ID NO: 83267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaaaataaaaattggact

SEQ ID NO: 83268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatacaaataatggtaagg

SEQ ID NO: 83269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatacaaataatggtaag

SEQ ID NO: 83270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatacaaataatggtaa

SEQ ID NO: 83271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaaaatcagttttcatat

SEQ ID NO: 83272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtcaaaataagattaaa

SEQ ID NO: 83273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaataattgaaagtcaaaat

SEQ ID NO: 83274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagactaaaataattgaaag

SEQ ID NO: 83275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatgttgtagactaaaata

SEQ ID NO: 83276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcactcaaatgttgtaga

SEQ ID NO: 83277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaattaaatcactcaaatg

SEQ ID NO: 83278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaattaaatcactcaaat

SEQ ID NO: 83279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccaattaaatcactcaaa

SEQ ID NO: 83280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttaccaattaaatcactc

SEQ ID NO: 83281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagcaattactttaccaat

SEQ ID NO: 83282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtaaacctgagagcaatta

SEQ ID NO: 83283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtaaacctgagagcaatt

SEQ ID NO: 83284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtaaacctgagagcaat

SEQ ID NO: 83285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacaacagagaaaaaatttt

SEQ ID NO: 83286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacacaacagagaaaaaatt

SEQ ID NO: 83287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacacaacagagaaaaaat

SEQ ID NO: 83288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctacacaacagagaaaaaa

SEQ ID NO: 83289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggatggtgttttctacac

SEQ ID NO: 83290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggaattcatggatggtgt

SEQ ID NO: 83291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacattaagggaattcatgg

SEQ ID NO: 83292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattgtacattaagggaatt

SEQ ID NO: 83293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactatattgtacattaagg

SEQ ID NO: 83294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactatattgtacattaag

SEQ ID NO: 83295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatactatattgtacattaa

SEQ ID NO: 83296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatactatattgtacatta

SEQ ID NO: 83297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaaaaataatttttatac

SEQ ID NO: 83298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaaaaaataatttttata

SEQ ID NO: 83299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaaaaaaataatttttat

SEQ ID NO: 83300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtaaaaaaataattttta

SEQ ID NO: 83301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttgtaaaaaaataattt

SEQ ID NO: 83302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaataaggctacttttgta

SEQ ID NO: 83303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaataaggctacttttgt

SEQ ID NO: 83304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaaataaggctacttttg

SEQ ID NO: 83305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaggtctttcaaaataagg

SEQ ID NO: 83306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaaggtctttcaaaata

SEQ ID NO: 83307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttattaaaaggtctttca

SEQ ID NO: 83308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttattaaaaggtctttc

SEQ ID NO: 83309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagttattaaaaggtcttt

SEQ ID NO: 83310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttcagttattaaaaggt

SEQ ID NO: 83311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattttcagttattaaaag

SEQ ID NO: 83312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaattttcagttattaaaa

SEQ ID NO: 83313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctaattttcagttattaaa

SEQ ID NO: 83314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatcgctttctaattttca

SEQ ID NO: 83315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagatcgctttctaattttc

SEQ ID NO: 83316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcacttaagatcgctttct

SEQ ID NO: 83317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggctggtcacttaagatc

SEQ ID NO: 83318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgatggctggtcacttaa

SEQ ID NO: 83319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattgatggctggtcactta

SEQ ID NO: 83320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcaaataataatgatgca

SEQ ID NO: 83321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattaatgcaaataata

SEQ ID NO: 83322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaattaatgcaaataat

SEQ ID NO: 83323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaattaatgcaaataa

SEQ ID NO: 83324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatggcattttaaaaaatt

SEQ ID NO: 83325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgatggcattttaaaaa

SEQ ID NO: 83326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaagttattatgatggcat

SEQ ID NO: 83327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctagcaagttattatgat

SEQ ID NO: 83328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgtgctagcaagttatta

SEQ ID NO: 83329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaattgtgctagcaagtta

SEQ ID NO: 83330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttaattgtgctagcaagt

SEQ ID NO: 83331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattctgttaattgtgctag

SEQ ID NO: 83332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaactacattctgttaatt

SEQ ID NO: 83333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaactacattctgttaat

SEQ ID NO: 83334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaagaaaaatttccaaac

SEQ ID NO: 83335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaagaaaaatttccaaa

SEQ ID NO: 83336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtttaataaagaaaaatt

SEQ ID NO: 83337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagtttaataaagaaaaat

SEQ ID NO: 83338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagtttaataaagaaaaa

SEQ ID NO: 83339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtagtttaataaagaaaa

SEQ ID NO: 83340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcttttgtagtttaataaa

SEQ ID NO: 83341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcttttgtagtttaataa

SEQ ID NO: 83342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatcttttgtagtttaata

SEQ ID NO: 83343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttaatcttttgtagttta

SEQ ID NO: 83344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actttaatcttttgtagttt

SEQ ID NO: 83345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactttaatcttttgtagtt

SEQ ID NO: 83346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactttaatcttttgtagt

SEQ ID NO: 83347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactttaatcttttgtag

SEQ ID NO: 83348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttactttaatcttttgta

SEQ ID NO: 83349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcatttttttactttaatc

SEQ ID NO: 83350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcatttttttactttaat

SEQ ID NO: 83351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaagtaaggaaccgataat

SEQ ID NO: 83352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaagtaaggaaccgataa

SEQ ID NO: 83353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaatttgaaaagtaaggaa

SEQ ID NO: 83354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaatttgaaaagtaagga

SEQ ID NO: 83355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtaatttgaaaagtaagg

SEQ ID NO: 83356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttggtaatttgaaaagta

SEQ ID NO: 83357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttggtaatttgaaaagt

SEQ ID NO: 83358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttggtaatttgaaaag

SEQ ID NO: 83359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttgttttggtaatttga

SEQ ID NO: 83360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattttgttttggtaatttg

SEQ ID NO: 83361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttcattttgttttggtaa

SEQ ID NO: 83362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatcaagactaccttcatt

SEQ ID NO: 83363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatcaagactaccttcat

SEQ ID NO: 83364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgggggtaaaccttaaaatc

SEQ ID NO: 83365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcgggggtaaaccttaaa

SEQ ID NO: 83366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgcgggggtaaaccttaa

SEQ ID NO: 83367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataacttgctgcgggggtaa

SEQ ID NO: 83368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cataacttgctgcgggggta

SEQ ID NO: 83369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcataacttgctgcgggggt

SEQ ID NO: 83370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcataacttgctgcggg

SEQ ID NO: 83371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acacatgtgaccattatttt

SEQ ID NO: 83372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacacatgtgaccattattt

SEQ ID NO: 83373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggaatatcagtataatat

SEQ ID NO: 83374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaaggaatatcagtataa

SEQ ID NO: 83375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagagtaagtaaaatgaaat

SEQ ID NO: 83376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaagagtaagtaaaatga

SEQ ID NO: 83377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatatctgttgaagagtaa

SEQ ID NO: 83378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatatctgttgaagagta

SEQ ID NO: 83379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatatctgttgaagagt

SEQ ID NO: 83380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatacacaataaagtgta

SEQ ID NO: 83381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatatacacaataaagtgt

SEQ ID NO: 83382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataccttaaatatacacaa

SEQ ID NO: 83383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgtatccaatagcatcat

SEQ ID NO: 83384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctacatgtatccaatagca

SEQ ID NO: 83385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatctacatgtatccaata

SEQ ID NO: 83386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatctacatgtatccaat

SEQ ID NO: 83387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactatctacatgtatccaa

SEQ ID NO: 83388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactatctacatgtatcca

SEQ ID NO: 83389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactatctacatgtatcc

SEQ ID NO: 83390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttactatctacatgtatc

SEQ ID NO: 83391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttactatctacatgtat

SEQ ID NO: 83392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttactatctacatgta

SEQ ID NO: 83393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggtaaccttttttttacta

SEQ ID NO: 83394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatggtaacctttttttta

SEQ ID NO: 83395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatggtaacctttttttt

SEQ ID NO: 83396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactatggtaaccttttttt

SEQ ID NO: 83397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttactatggtaacctttt

SEQ ID NO: 83398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttactatggtaaccttt

SEQ ID NO: 83399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttcctttactatggtaac

SEQ ID NO: 83400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagatggtagatatgttaat

SEQ ID NO: 83401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaacaacaacaacaacccc

SEQ ID NO: 83402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctccaaacaacaacaacaa

SEQ ID NO: 83403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acctccaaacaacaacaaca

SEQ ID NO: 83404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttacctccaaacaacaacaa

SEQ ID NO: 83405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcttacctccaaacaacaa

SEQ ID NO: 83406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgctcttacctccaaacaa

SEQ ID NO: 83407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgctcttacctccaaaca

SEQ ID NO: 83408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatatttgttgctcttac

SEQ ID NO: 83409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaatatttgttgctctta

SEQ ID NO: 83410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaccttaaaaatatttgtt

SEQ ID NO: 83411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcccaggcacctggcacc

SEQ ID NO: 83412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtattgtgtcccaggcacct

SEQ ID NO: 83413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttagtattgtgtcccaggc

SEQ ID NO: 83414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggacaaggatcaaggcca

SEQ ID NO: 83415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagccctagaggacaagga

SEQ ID NO: 83416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccaacagactgtaagccct

SEQ ID NO: 83417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccaacagactgtaagccc

SEQ ID NO: 83418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccaacagactgtaagcc

SEQ ID NO: 83419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttttccccaacagactgta

SEQ ID NO: 83420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctggttttccccaacagact

SEQ ID NO: 83421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgctggttttccccaaca

SEQ ID NO: 83422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgctggttttccccaac

SEQ ID NO: 83423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttacctgctggttttcccc

SEQ ID NO: 83424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattgtttacctgctggtt

SEQ ID NO: 83425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatagtaggtgtgttgtaa

SEQ ID NO: 83426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatatagtaggtgtgttgt

SEQ ID NO: 83427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctcatatagtaggtgtgt

SEQ ID NO: 83428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attgctctcatatagtaggt

SEQ ID NO: 83429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattgctctcatatagtag

SEQ ID NO: 83430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgttctcattgctctcat

SEQ ID NO: 83431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgtgttctcattgctctc

SEQ ID NO: 83432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtgtgttctcattgctct

SEQ ID NO: 83433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtgtgttctcattgctc

SEQ ID NO: 83434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgtgtgttctcattgct

SEQ ID NO: 83435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtgccttttctgtgtgttc

SEQ ID NO: 83436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtccaagttaggtgccttt

SEQ ID NO: 83437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaagtccaagttaggtgcc

SEQ ID NO: 83438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctaagtccaagttaggtgc

SEQ ID NO: 83439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctaagtccaagttaggt

SEQ ID NO: 83440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcctaagtccaagttagg

SEQ ID NO: 83441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttcctaagtccaagttag

SEQ ID NO: 83442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accaaaatctttcttcctaa

SEQ ID NO: 83443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgaccaaaatctttcttc

SEQ ID NO: 83444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgaccaaaatctttctt

SEQ ID NO: 83445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccctgaccaaaatcttt

SEQ ID NO: 83446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttccctgaccaaaatctt

SEQ ID NO: 83447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcttccttccctgaccaaa

SEQ ID NO: 83448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcatcttccttccctgacc

SEQ ID NO: 83449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactcatcttccttccctga

SEQ ID NO: 83450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactcatcttccttccctg

SEQ ID NO: 83451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatagtacagaccagcaaa

SEQ ID NO: 83452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggagatacctgtcatagt

SEQ ID NO: 83453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacaagagggaggaattgt

SEQ ID NO: 83454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaacacaagagggaggaat

SEQ ID NO: 83455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcatagcaaactgttaac

SEQ ID NO: 83456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggatcatagcaaactgtt

SEQ ID NO: 83457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgacaaagccaaaaatgaa

SEQ ID NO: 83458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgacaaagccaaaaatga

SEQ ID NO: 83459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagtaagtaaggacaatca

SEQ ID NO: 83460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaagttgagagtaagtaa

SEQ ID NO: 83461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaagttgagagtaagta

SEQ ID NO: 83462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttggaaaagttgagagtaa

SEQ ID NO: 83463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttggaaaagttgagagta

SEQ ID NO: 83464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtttggaaaagttgagag

SEQ ID NO: 83465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtttggaaaagttgaga

SEQ ID NO: 83466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgtttggaaaagttgag

SEQ ID NO: 83467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttgtttggaaaagttga

SEQ ID NO: 83468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttgtttggaaaagttg

SEQ ID NO: 83469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttgtttggaaaagtt

SEQ ID NO: 83470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttcttgtttggaaaagt

SEQ ID NO: 83471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcgaaggacaaagccaaa

SEQ ID NO: 83472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattccatcgaaggacaaa

SEQ ID NO: 83473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaattccatcgaaggacaa

SEQ ID NO: 83474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatatttcaaattccatcga

SEQ ID NO: 83475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaagctatatatttcaaat

SEQ ID NO: 83476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaagctatatatttcaaa

SEQ ID NO: 83477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagagtttatgaagctatat

SEQ ID NO: 83478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gacaagtacaggaatagaaa

SEQ ID NO: 83479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagactagacaagtacagga

SEQ ID NO: 83480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagactagacaagtacagg

SEQ ID NO: 83481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatagtttgaagactagac

SEQ ID NO: 83482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagaatagtttgaagact

SEQ ID NO: 83483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattagaatagtttgaagac

SEQ ID NO: 83484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattagaatagtttgaaga

SEQ ID NO: 83485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattagaatagtttgaag

SEQ ID NO: 83486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttttaattagaatagt

SEQ ID NO: 83487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatttttaattagaatag

SEQ ID NO: 83488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatttttaattagaata

SEQ ID NO: 83489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcatcctttaaaattttta

SEQ ID NO: 83490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcatcctttaaaattttt

SEQ ID NO: 83491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgcatcctttaaaatttt

SEQ ID NO: 83492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaggaaaataagctttgtg

SEQ ID NO: 83493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaggaaaataagctttgt

SEQ ID NO: 83494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaaggaaaataagctttg

SEQ ID NO: 83495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctttagaaggaaaataag

SEQ ID NO: 83496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctttagaaggaaaataa

SEQ ID NO: 83497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatttaacctttagaagga

SEQ ID NO: 83498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccacaatacaagtaagtta

SEQ ID NO: 83499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atattatccacaatacaagt

SEQ ID NO: 83500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgatattatccacaatac

SEQ ID NO: 83501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttgatattatccacaata

SEQ ID NO: 83502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggttgatattatccacaat

SEQ ID NO: 83503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagaatgcaggaactttggt

SEQ ID NO: 83504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaatctgtagaatgcag

SEQ ID NO: 83505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggttaaaaaaatctgtaga

SEQ ID NO: 83506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggttaaaaaaatctgtag

SEQ ID NO: 83507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacttgaggttaaaaaaat

SEQ ID NO: 83508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctggaacttgaggttaaa

SEQ ID NO: 83509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctggaacttgaggttaa

SEQ ID NO: 83510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaatttaacctggaacttg

SEQ ID NO: 83511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccacaaactgggaatttaa

SEQ ID NO: 83512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catggccaatgataacaatt

SEQ ID NO: 83513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatggccaatgataacaat

SEQ ID NO: 83514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcatggccaatgataacaa

SEQ ID NO: 83515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaaggaggctttgcatg

SEQ ID NO: 83516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcatgggaatgaaaaacag

SEQ ID NO: 83517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaagcatgggaatgaaaaa

SEQ ID NO: 83518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatggttgctaagcatggg

SEQ ID NO: 83519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaacacattataatggtt

SEQ ID NO: 83520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaaaacagaaagatgttc

SEQ ID NO: 83521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagaaaacagaaagatgtt

SEQ ID NO: 83522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagaaaacagaaagatgt

SEQ ID NO: 83523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttcaagaaaacagaaa

SEQ ID NO: 83524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgtacaatattcaattt

SEQ ID NO: 83525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagattcatgtgtacaatat

SEQ ID NO: 83526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaataaaaacaaacaatg

SEQ ID NO: 83527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtaaataaaaacaaacaat

SEQ ID NO: 83528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcatagtgcttagtaaat

SEQ ID NO: 83529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcatagtgcttagtaaa

SEQ ID NO: 83530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatcatagtgcttagtaa

SEQ ID NO: 83531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtactttaaatcatagtgc

SEQ ID NO: 83532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacaacatgaatgctaagt

SEQ ID NO: 83533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaacaacatgaatgctaag

SEQ ID NO: 83534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatgtatttacaacaacatg

SEQ ID NO: 83535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagtgcagattagatgtat

SEQ ID NO: 83536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcagtagttagaagtgcag

SEQ ID NO: 83537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatattatgcagtagttag

SEQ ID NO: 83538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaatatacactggaatatt

SEQ ID NO: 83539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagagcaaataggtaaaat

SEQ ID NO: 83540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcactaagagagcaaatagg

SEQ ID NO: 83541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaggtgttatcactaagag

SEQ ID NO: 83542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattgccaggtgttatcact

SEQ ID NO: 83543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctggattgccaggtgttatc

SEQ ID NO: 83544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggactgctggattgccagg

SEQ ID NO: 83545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagaaggttggggactgct

SEQ ID NO: 83546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccaagaaggttggggac

SEQ ID NO: 83547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttccaagaaggttgggga

SEQ ID NO: 83548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgaaaccagtccttggtt

SEQ ID NO: 83549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatgaaaccagtccttggt

SEQ ID NO: 83550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttccatgaaaccagtcct

SEQ ID NO: 83551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaaattgtcttccatgaa

SEQ ID NO: 83552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctgaaaaaattgtcttcc

SEQ ID NO: 83553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgccctgaaaaaattgtct

SEQ ID NO: 83554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgctgccctgaaaaaatt

SEQ ID NO: 83555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgctgccctgaaaaaat

SEQ ID NO: 83556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttccctgctgccctgaaaa

SEQ ID NO: 83557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctccttccctgctgccctg

SEQ ID NO: 83558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtcccaaaacctacctcctt

SEQ ID NO: 83559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtcccaaaacctacctcct

SEQ ID NO: 83560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtggaatagtttcgtccc

SEQ ID NO: 83561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcatctgaagtggaatagt

SEQ ID NO: 83562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgcctgatcatctgaagtg

SEQ ID NO: 83563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actaatgcctgatcatctga

SEQ ID NO: 83564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taactaatgcctgatcatct

SEQ ID NO: 83565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagactctaactaatgcct

SEQ ID NO: 83566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgagactctaactaatgcc

SEQ ID NO: 83567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttatgagactctaactaat

SEQ ID NO: 83568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacactccttatgagactct

SEQ ID NO: 83569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttgcacactccttatgag

SEQ ID NO: 83570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacatacgagggatctaagt

SEQ ID NO: 83571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaactgcacatacgaggga

SEQ ID NO: 83572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgaactgcacatacgag

SEQ ID NO: 83573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtgaactgcacatacga

SEQ ID NO: 83574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattgtgaactgcacatacg

SEQ ID NO: 83575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagaagtgcaagctttatt

SEQ ID NO: 83576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagagaagtgcaagcttta

SEQ ID NO: 83577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gactctcagagaagtgcaag

SEQ ID NO: 83578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcattagactctcagagaag

SEQ ID NO: 83579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcattagactctcagagaa

SEQ ID NO: 83580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatcagccttggcattagac

SEQ ID NO: 83581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttagatcagccttggcatta

SEQ ID NO: 83582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgttagatcagccttggca

SEQ ID NO: 83583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcctgttagatcagccttg

SEQ ID NO: 83584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcctgttagatcagcctt

SEQ ID NO: 83585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctcctgttagatcagcc

SEQ ID NO: 83586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttcttcctcctgttagat

SEQ ID NO: 83587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacctgagttcttcctcct

SEQ ID NO: 83588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacagcaggaggtgagcagc

SEQ ID NO: 83589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaccaggctgcacagcag

SEQ ID NO: 83590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaggaaccaggctgcacag

SEQ ID NO: 83591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtccatggcctgttaggaac

SEQ ID NO: 83592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggccagtgacagatactggt

SEQ ID NO: 83593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcccctgggccagtgaca

SEQ ID NO: 83594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatcccctgggccagtgac

SEQ ID NO: 83595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatcaggggtttccatcccc

SEQ ID NO: 83596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggccacagtgggttagat

SEQ ID NO: 83597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataggccacagtgggttaga

SEQ ID NO: 83598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttataggccacagtgggtt

SEQ ID NO: 83599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatctgtttataggccacag

SEQ ID NO: 83600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataagccacagatccataa

SEQ ID NO: 83601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccccagttgtataagccaca

SEQ ID NO: 83602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcccccagttgtataagcc

SEQ ID NO: 83603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacctcctcccccagttgta

SEQ ID NO: 83604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacctcctcccccagttg

SEQ ID NO: 83605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaacctcctcccccagtt

SEQ ID NO: 83606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaacctcctcccccagt

SEQ ID NO: 83607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcaacctcctcccccag

SEQ ID NO: 83608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctcaacctcctccccca

SEQ ID NO: 83609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattttttctcaacctcctc

SEQ ID NO: 83610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattttttctcaacctcct

SEQ ID NO: 83611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcattttttctcaacctcc

SEQ ID NO: 83612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcattttttctcaacctc

SEQ ID NO: 83613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttgcattttttctca

SEQ ID NO: 83614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatttttgcattttttctc

SEQ ID NO: 83615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccttgtatttttgcatttt

SEQ ID NO: 83616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccttgtatttttgcattt

SEQ ID NO: 83617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttgcccttgtatttttgc

SEQ ID NO: 83618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcctaatttgcccttgtat

SEQ ID NO: 83619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcctaatttgcccttgta

SEQ ID NO: 83620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgcctaatttgcccttgt

SEQ ID NO: 83621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtgcctaatttgcccttg

SEQ ID NO: 83622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttttgtgcctaatttgcc

SEQ ID NO: 83623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctgtcttttgtgcctaat

SEQ ID NO: 83624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattaatctgtcttttgtgc

SEQ ID NO: 83625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattaatctgtcttttgtg

SEQ ID NO: 83626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattaatctgtcttttgt

SEQ ID NO: 83627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatattaatctgtcttttg

SEQ ID NO: 83628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttttatattaatctgtct

SEQ ID NO: 83629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaacattcacttttatat

SEQ ID NO: 83630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaacattcacttttata

SEQ ID NO: 83631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataaacattcacttttat

SEQ ID NO: 83632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaataaacattcactttta

SEQ ID NO: 83633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttttaataaacattcact

SEQ ID NO: 83634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacttttaataaacattca

SEQ ID NO: 83635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctcacttttaataaacat

SEQ ID NO: 83636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctcacttttaataaaca

SEQ ID NO: 83637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttctcacttttaataaac

SEQ ID NO: 83638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttctcacttttaataaa

SEQ ID NO: 83639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttgttctcacttttaa

SEQ ID NO: 83640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttttgttctcactttta

SEQ ID NO: 83641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatttttgttctcactt

SEQ ID NO: 83642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttaatttttgttctcact

SEQ ID NO: 83643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacagagacaacttattta

SEQ ID NO: 83644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatacagagacaacttattt

SEQ ID NO: 83645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatacagagacaacttatt

SEQ ID NO: 83646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatacagagacaacttat

SEQ ID NO: 83647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttaatacagagacaact

SEQ ID NO: 83648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatttttaatacagagac

SEQ ID NO: 83649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaattatttttaatacag

SEQ ID NO: 83650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtattggttaattatttt

SEQ ID NO: 83651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggtattggttaattattt

SEQ ID NO: 83652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatttatggtattggttaa

SEQ ID NO: 83653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaatttatggtattggtta

SEQ ID NO: 83654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaatttatggtattggtt

SEQ ID NO: 83655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaattttggaatttatg

SEQ ID NO: 83656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggagtaaattaataaaatt

SEQ ID NO: 83657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagaaatgtgttaaggagta

SEQ ID NO: 83658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atacaaagtaaagggaagat

SEQ ID NO: 83659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaattgatacaaagtaaa

SEQ ID NO: 83660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattacaaaattgatacaaa

SEQ ID NO: 83661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccattacaaaattgataca

SEQ ID NO: 83662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccattacaaaattgatac

SEQ ID NO: 83663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttctccattacaaaattg

SEQ ID NO: 83664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcttctccattacaaaat

SEQ ID NO: 83665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatcttctccattacaaaa

SEQ ID NO: 83666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatcttctccattacaaa

SEQ ID NO: 83667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctatcttctccattacaa

SEQ ID NO: 83668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatttttctatcttctccat

SEQ ID NO: 83669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtaaaagaaagactaaat

SEQ ID NO: 83670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agttgtggtaaaagaaagac

SEQ ID NO: 83671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactcagttgtggtaaaaga

SEQ ID NO: 83672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcagtaatgaacatacacac

SEQ ID NO: 83673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactatcagtaatgaacata

SEQ ID NO: 83674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcaactatcagtaatgaac

SEQ ID NO: 83675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcaactatcagtaatgaa

SEQ ID NO: 83676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagaaatttgctcaactat

SEQ ID NO: 83677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaactcagagaaatttgc

SEQ ID NO: 83678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaaaacaagttgtaaaac

SEQ ID NO: 83679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgccattaccaaaaacaag

SEQ ID NO: 83680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgccattaccaaaaacaa

SEQ ID NO: 83681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgccattaccaaaaaca

SEQ ID NO: 83682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaattttcatgccattacc

SEQ ID NO: 83683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagtaatactgaaaatttt

SEQ ID NO: 83684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagtaatactgaaaattt

SEQ ID NO: 83685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaatttgacagtaatact

SEQ ID NO: 83686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atggaggtgttcccaaattt

SEQ ID NO: 83687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatggaggtgttcccaaatt

SEQ ID NO: 83688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatgtgaaagaaacttgat

SEQ ID NO: 83689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caactcatatgtgaaagaaa

SEQ ID NO: 83690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaactcatatgtgaaagaa

SEQ ID NO: 83691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatcttacaactcatatgt

SEQ ID NO: 83692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatatcttacaactcatat

SEQ ID NO: 83693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacaggctctgatatcttac

SEQ ID NO: 83694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataaggacactgtacaggc

SEQ ID NO: 83695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaataaggacactgtacag

SEQ ID NO: 83696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaataaggacactgtaca

SEQ ID NO: 83697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttctgaataaggacactg

SEQ ID NO: 83698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtatataagattagcttc

SEQ ID NO: 83699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagtatataagattagctt

SEQ ID NO: 83700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcgatttagagtatataaga

SEQ ID NO: 83701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgttgtcgatttagagta

SEQ ID NO: 83702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataacagagtggttgggtgt

SEQ ID NO: 83703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggatattgataacagagtg

SEQ ID NO: 83704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattgaggatattgataaca

SEQ ID NO: 83705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atacatcactacattgagga

SEQ ID NO: 83706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catacatcactacattgagg

SEQ ID NO: 83707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcatacatcactacattga

SEQ ID NO: 83708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agataacaaactcttcatac

SEQ ID NO: 83709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccataaaatggccaaacatg

SEQ ID NO: 83710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccataaaatggccaaacat

SEQ ID NO: 83711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttgccataaaatggccaa

SEQ ID NO: 83712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcatttgccataaaatggc

SEQ ID NO: 83713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctcatttgccataaaatgg

SEQ ID NO: 83714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatgtcttgctcatttgcc

SEQ ID NO: 83715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaaaaatattaggatgtc

SEQ ID NO: 83716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagaagagtgaatcatat

SEQ ID NO: 83717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagaagagtgaatcata

SEQ ID NO: 83718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaataatccagtttataa

SEQ ID NO: 83719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattgtgtaataatccagtt

SEQ ID NO: 83720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggattgtgtaataatccagt

SEQ ID NO: 83721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggattgtgtaataatcca

SEQ ID NO: 83722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaattcttggattgtgt

SEQ ID NO: 83723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaataaattcttggattg

SEQ ID NO: 83724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcactattaaataaattc

SEQ ID NO: 83725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagcactattaaataaatt

SEQ ID NO: 83726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttatagcactattaaataaa

SEQ ID NO: 83727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctcttatagcactattaa

SEQ ID NO: 83728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagaagaagacactcatct

SEQ ID NO: 83729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaagaagaagacactcat

SEQ ID NO: 83730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaagaagaagacactca

SEQ ID NO: 83731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctcaaagaagaagacac

SEQ ID NO: 83732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcataccagaagcaaaagta

SEQ ID NO: 83733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcataccagaagcaaaagt

SEQ ID NO: 83734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcataccagaagcaaaag

SEQ ID NO: 83735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taacaaagttttgtcatacc

SEQ ID NO: 83736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaatgaactataacaaag

SEQ ID NO: 83737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattgagcaatgaactata

SEQ ID NO: 83738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattaacattgagcaatgaa

SEQ ID NO: 83739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaggatgagcaataaaata

SEQ ID NO: 83740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtggaatatgaaacaaaagt

SEQ ID NO: 83741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtagtgatggaaagttag

SEQ ID NO: 83742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattaaagtagtgatggaaa

SEQ ID NO: 83743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattaaagtagtgatggaa

SEQ ID NO: 83744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattaaagtagtgatgga

SEQ ID NO: 83745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatattaaagtagtgatgg

SEQ ID NO: 83746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatattaaagtagtgatg

SEQ ID NO: 83747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttttatattaaagtagt

SEQ ID NO: 83748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactttttatattaaagtag

SEQ ID NO: 83749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgactttttatattaaagta

SEQ ID NO: 83750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgactttttatattaaagt

SEQ ID NO: 83751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatttttgactttttatat

SEQ ID NO: 83752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcatttttgactttttata

SEQ ID NO: 83753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcatttttgactttttat

SEQ ID NO: 83754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtcatttttgacttttt

SEQ ID NO: 83755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcatatcatatgacattc

SEQ ID NO: 83756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatagaaaaaaaagtagaca

SEQ ID NO: 83757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatattggatagaaaaaaaa

SEQ ID NO: 83758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gataagaaggaagattggat

SEQ ID NO: 83759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagataagaaggaagattgg

SEQ ID NO: 83760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctagataagaaggaaga

SEQ ID NO: 83761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcattctagataagaagga

SEQ ID NO: 83762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacacaatgggaaatacctg

SEQ ID NO: 83763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcaccactacacacaatg

SEQ ID NO: 83764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattccatcaccactacaca

SEQ ID NO: 83765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaattccatcaccactaca

SEQ ID NO: 83766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacggcaggtgtcaaggctc

SEQ ID NO: 83767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacggcaggtgtcaaggct

SEQ ID NO: 83768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccacggcaggtgtcaaggc

SEQ ID NO: 83769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctttccacggcaggtgtca

SEQ ID NO: 83770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctttccacggcaggtgtc

SEQ ID NO: 83771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagctttccacggcaggtgt

SEQ ID NO: 83772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcactttagctttccacgg

SEQ ID NO: 83773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcactttagctttccacg

SEQ ID NO: 83774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtcactttagctttccac

SEQ ID NO: 83775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataacaggagtggaatgg

SEQ ID NO: 83776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaataacaggagtggaatg

SEQ ID NO: 83777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accacttaaaataacaggag

SEQ ID NO: 83778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagatgatggcctcaccac

SEQ ID NO: 83779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggagatgatggcctcacca

SEQ ID NO: 83780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataagcttaggagatgatg

SEQ ID NO: 83781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataagcttaggagatgat

SEQ ID NO: 83782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagtaaagggcaacagaat

SEQ ID NO: 83783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accaagttcaaagtaaaggg

SEQ ID NO: 83784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcaccaagttcaaagtaa

SEQ ID NO: 83785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattcaccaagttcaaagta

SEQ ID NO: 83786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttcattcaccaagttcaa

SEQ ID NO: 83787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttcattcaccaagttca

SEQ ID NO: 83788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttggcttcattcaccaagt

SEQ ID NO: 83789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttggcttcattcaccaag

SEQ ID NO: 83790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttggcttcattcaccaa

SEQ ID NO: 83791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttatttggcttcattcac

SEQ ID NO: 83792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttatttggcttcattca

SEQ ID NO: 83793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataaaatcttcctttattt

SEQ ID NO: 83794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caataaaatcttcctttatt

SEQ ID NO: 83795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacatagacccagcacaagg

SEQ ID NO: 83796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagctgtacatagacccagc

SEQ ID NO: 83797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatagctgtacatagaccc

SEQ ID NO: 83798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactatagctgtacatagac

SEQ ID NO: 83799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacacaggattctactata

SEQ ID NO: 83800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgccacacaggattctact

SEQ ID NO: 83801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcactgctgccacacagga

SEQ ID NO: 83802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctggtcactgctgccacaca

SEQ ID NO: 83803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactactggtcactgctgcc

SEQ ID NO: 83804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctagactactggtcactgc

SEQ ID NO: 83805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcagacccagctggctagac

SEQ ID NO: 83806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcagacccagctggctaga

SEQ ID NO: 83807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttggcagacccagctggct

SEQ ID NO: 83808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggctgtttggcagaccca

SEQ ID NO: 83809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaaaagggaaatctagagg

SEQ ID NO: 83810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tataggaaaatgagctgaca

SEQ ID NO: 83811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagcagctgtataggaaaat

SEQ ID NO: 83812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaactagagcagctgtat

SEQ ID NO: 83813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaaactagagcagctgta

SEQ ID NO: 83814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaaactagagcagctgt

SEQ ID NO: 83815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaggctttgggaaactaga

SEQ ID NO: 83816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggaaggctttgggaaac

SEQ ID NO: 83817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcattcattggaaggctt

SEQ ID NO: 83818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtactcatgcattcattgg

SEQ ID NO: 83819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgggtactcatgcattcat

SEQ ID NO: 83820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagttgttgggtactcatg

SEQ ID NO: 83821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggaagttgttgggtactc

SEQ ID NO: 83822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attggaagttgttgggtact

SEQ ID NO: 83823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcccaagccaaatggagatt

SEQ ID NO: 83824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgtcccaagccaaatgga

SEQ ID NO: 83825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagcaagagaaacaaacac

SEQ ID NO: 83826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attacaagcaagagaaacaa

SEQ ID NO: 83827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcaaagatattgattacaa

SEQ ID NO: 83828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atattaagcaaagatattga

SEQ ID NO: 83829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatattaagcaaagatatt

SEQ ID NO: 83830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatattaagcaaagatat

SEQ ID NO: 83831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacaaagtgagccaaaagt

SEQ ID NO: 83832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttcccacaaagtgagccaa

SEQ ID NO: 83833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcataacctagttcccaca

SEQ ID NO: 83834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtcataacctagttcccac

SEQ ID NO: 83835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtcataacctagttccca

SEQ ID NO: 83836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttggtcataacctagttc

SEQ ID NO: 83837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttggtcataacctagtt

SEQ ID NO: 83838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatagccaaaaggagcttg

SEQ ID NO: 83839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaaactgtcatagccaaa

SEQ ID NO: 83840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcaaaactgtcatagccaa

SEQ ID NO: 83841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcacttagcaaaactgtca

SEQ ID NO: 83842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcacttagcaaaactgtc

SEQ ID NO: 83843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatcacttagcaaaactgt

SEQ ID NO: 83844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagaaatgctttaatcac

SEQ ID NO: 83845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgattcagaagaaatgc

SEQ ID NO: 83846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtgattcagaagaaatg

SEQ ID NO: 83847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagtgattcagaagaaat

SEQ ID NO: 83848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttcaagtgattcagaag

SEQ ID NO: 83849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtcaagtgattaattttc

SEQ ID NO: 83850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaggtcaagtgattaattt

SEQ ID NO: 83851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaggtcaagtgattaatt

SEQ ID NO: 83852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttctgaggtcaagtgatta

SEQ ID NO: 83853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcactacttctgaggtca

SEQ ID NO: 83854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcactacttctgaggtc

SEQ ID NO: 83855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatcactacttctgaggt

SEQ ID NO: 83856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaatcactacttctgagg

SEQ ID NO: 83857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttaaatcactacttctga

SEQ ID NO: 83858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttaaatcactacttctg

SEQ ID NO: 83859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttcttttaaatcactac

SEQ ID NO: 83860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattatgtttcttttaaatc

SEQ ID NO: 83861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagactgcattatgtttctt

SEQ ID NO: 83862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagactgcattatgtttct

SEQ ID NO: 83863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catttacagactgcattatg

SEQ ID NO: 83864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcatttacagactgcatta

SEQ ID NO: 83865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatggattctgcatttaca

SEQ ID NO: 83866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtataagaagtaatatga

SEQ ID NO: 83867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtataagaagtaatatg

SEQ ID NO: 83868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatagtataagaagtaatat

SEQ ID NO: 83869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttatagtataagaagtaa

SEQ ID NO: 83870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaagataatgagcaaaat

SEQ ID NO: 83871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaataaagataatgagcaa

SEQ ID NO: 83872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaaatattattaataaag

SEQ ID NO: 83873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggatattgcagaaatatta

SEQ ID NO: 83874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gactgtggatattgcagaaa

SEQ ID NO: 83875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggactgtggatattgcagaa

SEQ ID NO: 83876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggactgtggatattgcaga

SEQ ID NO: 83877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtccaaaataaaagttttgg

SEQ ID NO: 83878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtccaaaataaaagttttg

SEQ ID NO: 83879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggacggacttagtccaaaa

SEQ ID NO: 83880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggacggacttagtccaaa

SEQ ID NO: 83881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggacggacttagtccaa

SEQ ID NO: 83882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgaattttaaggacgga

SEQ ID NO: 83883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtgaattttaaggacgg

SEQ ID NO: 83884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaataatagtgtagaagat

SEQ ID NO: 83885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaactaagaataatagtgt

SEQ ID NO: 83886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaactaagaataatagtg

SEQ ID NO: 83887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaactaagaataatagt

SEQ ID NO: 83888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaactaagaataatag

SEQ ID NO: 83889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttaaaaactaagaata

SEQ ID NO: 83890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttttaaaaactaagaat

SEQ ID NO: 83891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgatttcatttttaaaaact

SEQ ID NO: 83892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctgtgatttcattttta

SEQ ID NO: 83893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatctgtgatttcattttt

SEQ ID NO: 83894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttacatctgtgatttca

SEQ ID NO: 83895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatatttacatctgtgatt

SEQ ID NO: 83896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttatatttacatctgtgat

SEQ ID NO: 83897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttatatttacatctgtga

SEQ ID NO: 83898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttgttatatttacatct

SEQ ID NO: 83899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttttgttatatttacatc

SEQ ID NO: 83900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataatggcttggttttgtt

SEQ ID NO: 83901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagattaaataatggcttg

SEQ ID NO: 83902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtcctgcaagattaaata

SEQ ID NO: 83903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atggtcctgcaagattaaat

SEQ ID NO: 83904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaaggcttatggtcctgc

SEQ ID NO: 83905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atggaaggcttatggtcctg

SEQ ID NO: 83906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttatggaaggcttatggtc

SEQ ID NO: 83907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatcatcaggttgcttatg

SEQ ID NO: 83908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtaagttagcatcatcag

SEQ ID NO: 83909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtagtaagttagcatcat

SEQ ID NO: 83910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtagtaagttagcatca

SEQ ID NO: 83911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtagtaagttagcatc

SEQ ID NO: 83912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttattgtagtaagttagc

SEQ ID NO: 83913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttattgtagtaagttag

SEQ ID NO: 83914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtttgttttattgtagt

SEQ ID NO: 83915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtattgaaagtttgtttt

SEQ ID NO: 83916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagtattgaaagtttgttt

SEQ ID NO: 83917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagtattgaaagtttgtt

SEQ ID NO: 83918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattttagagtattgaa

SEQ ID NO: 83919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatattttagagtattga

SEQ ID NO: 83920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatattttagagtattg

SEQ ID NO: 83921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttaaaatattttagagt

SEQ ID NO: 83922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttaaaatattttagag

SEQ ID NO: 83923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagaaaatttaattttaaa

SEQ ID NO: 83924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagaaaatttaattttaa

SEQ ID NO: 83925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagaaaatttaatttta

SEQ ID NO: 83926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatataataaaatataatt

SEQ ID NO: 83927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatataataaaatataat

SEQ ID NO: 83928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaatataataaaatataa

SEQ ID NO: 83929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaatataataaaatata

SEQ ID NO: 83930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggacaaaaatatttttgaa

SEQ ID NO: 83931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggacaaaaatatttttga

SEQ ID NO: 83932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaggacaaaaatattttt

SEQ ID NO: 83933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgaggacaaaaatatttt

SEQ ID NO: 83934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgaggacaaaaatattt

SEQ ID NO: 83935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatattttcttgaggacaa

SEQ ID NO: 83936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccatattttcttgaggaca

SEQ ID NO: 83937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatttgccatattttcttga

SEQ ID NO: 83938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatttgccatattttcttg

SEQ ID NO: 83939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggatttgccatattttct

SEQ ID NO: 83940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataaatatattcttggat

SEQ ID NO: 83941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaataaatatattcttgga

SEQ ID NO: 83942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaaataaatatattcttg

SEQ ID NO: 83943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaaataaatatattctt

SEQ ID NO: 83944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttcttaaaataaatata

SEQ ID NO: 83945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttcttaaaataaatat

SEQ ID NO: 83946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatatttcttaaaataaa

SEQ ID NO: 83947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactatttatatttcttaaa

SEQ ID NO: 83948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatactatttatatttctt

SEQ ID NO: 83949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatactatttatatttct

SEQ ID NO: 83950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattatactatttatatttc

SEQ ID NO: 83951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataactttattatactattt

SEQ ID NO: 83952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataactttattatactatt

SEQ ID NO: 83953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaataactttattatact

SEQ ID NO: 83954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttaataactttattat

SEQ ID NO: 83955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattattatttaataactt

SEQ ID NO: 83956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaattattatttaataact

SEQ ID NO: 83957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttacaattattatttaataa

SEQ ID NO: 83958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcattcttacaattatta

SEQ ID NO: 83959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaccaagataaaatattata

SEQ ID NO: 83960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaccaagataaaatattat

SEQ ID NO: 83961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttagaccaagataaaata

SEQ ID NO: 83962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaccactggtttagacca

SEQ ID NO: 83963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaggaccactggtttaga

SEQ ID NO: 83964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctgttgaggaccactggt

SEQ ID NO: 83965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggtagggaagaattatcc

SEQ ID NO: 83966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacctggaggtagggaagaa

SEQ ID NO: 83967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaactccacctggaggtag

SEQ ID NO: 83968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtaactccacctggaggt

SEQ ID NO: 83969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actctggtaactccacctgg

SEQ ID NO: 83970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaactctggtaactccacc

SEQ ID NO: 83971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaactctggtaactccac

SEQ ID NO: 83972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctaactctggtaactcca

SEQ ID NO: 83973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctaactctggtaactcc

SEQ ID NO: 83974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgctaactctggtaactc

SEQ ID NO: 83975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgctaactctggtaac

SEQ ID NO: 83976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtattctttttgctaactc

SEQ ID NO: 83977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actgtgtattctttttgcta

SEQ ID NO: 83978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgactgtgtattcttttt

SEQ ID NO: 83979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactgactgtgtattctttt

SEQ ID NO: 83980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatttaactgactgtgtat

SEQ ID NO: 83981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtcagaatatgtatacac

SEQ ID NO: 83982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggtcagaatatgtataca

SEQ ID NO: 83983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttatggtcagaatatgt

SEQ ID NO: 83984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttatggtcagaatatg

SEQ ID NO: 83985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaaacatttccatttatg

SEQ ID NO: 83986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaaaaacatttccattta

SEQ ID NO: 83987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgtaaaaacatttccat

SEQ ID NO: 83988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agactgttctgtaaaaacat

SEQ ID NO: 83989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattaagactgttctgtaa

SEQ ID NO: 83990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagattaagactgttctgta

SEQ ID NO: 83991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagattaagactgttctgt

SEQ ID NO: 83992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaattttaagattaagac

SEQ ID NO: 83993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataaacaattagtaaattt

SEQ ID NO: 83994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agataaacaattagtaaatt

SEQ ID NO: 83995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagataaacaattagtaaat

SEQ ID NO: 83996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttagataaacaattagta

SEQ ID NO: 83997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttagataaacaattagt

SEQ ID NO: 83998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcatttattttagataaac

SEQ ID NO: 83999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catactgatcatttatttta

SEQ ID NO: 84000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatactgatcatttatttt

SEQ ID NO: 84001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttacatactgatcattta

SEQ ID NO: 84002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatttacatactgatcatt

SEQ ID NO: 84003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaagaaatctctaattt

SEQ ID NO: 84004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaaagaaatctctaatt

SEQ ID NO: 84005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaaaagaaatctctaat

SEQ ID NO: 84006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaaagccaatcatcgagg

SEQ ID NO: 84007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaatgaaagccaatcatcg

SEQ ID NO: 84008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaacaaggagctgttaat

SEQ ID NO: 84009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcaaaacaaggagctgtta

SEQ ID NO: 84010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtcaactctgcaaaaca

SEQ ID NO: 84011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagtcaactctgcaaaac

SEQ ID NO: 84012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataagtcaactctgcaaaa

SEQ ID NO: 84013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaggaattttataagtcaa

SEQ ID NO: 84014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actataaggaattttataag

SEQ ID NO: 84015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactataaggaattttataa

SEQ ID NO: 84016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taactataaggaattttata

SEQ ID NO: 84017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagggggaacataggcttta

SEQ ID NO: 84018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattgtagggggaacatagg

SEQ ID NO: 84019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggaagacatgttacattgt

SEQ ID NO: 84020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgtgaccactatggaaga

SEQ ID NO: 84021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatgtgaccactatggaag

SEQ ID NO: 84022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatggagaaaagagaaaatt

SEQ ID NO: 84023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaatgttgaatggagaaa

SEQ ID NO: 84024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attaatgaatgttgaatgga

SEQ ID NO: 84025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattaatgaatgttgaatg

SEQ ID NO: 84026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgatgttctcattaatgaa

SEQ ID NO: 84027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacgatgttctcattaatga

SEQ ID NO: 84028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacttcacgatgttctcatt

SEQ ID NO: 84029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagctggacttcacgatgt

SEQ ID NO: 84030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataagctggacttcacgatg

SEQ ID NO: 84031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacttataagctggacttca

SEQ ID NO: 84032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataagctggacttataagc

SEQ ID NO: 84033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacatgttcaataagctgga

SEQ ID NO: 84034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acactgaacatgttcaataa

SEQ ID NO: 84035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaggctaacactgaacatg

SEQ ID NO: 84036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaggctaacactgaacat

SEQ ID NO: 84037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagtccagcttataaggc

SEQ ID NO: 84038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcaatacatgttcagaag

SEQ ID NO: 84039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtcaatacatgttcagaa

SEQ ID NO: 84040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagtcaatacatgttcaga

SEQ ID NO: 84041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actttaagtcaatacatgtt

SEQ ID NO: 84042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaaaagagtaagtcccaga

SEQ ID NO: 84043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaaaagagtaagtcccag

SEQ ID NO: 84044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcaaaagagtaagtccca

SEQ ID NO: 84045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttagcaaaagagtaagtcc

SEQ ID NO: 84046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttctttagcaaaagagta

SEQ ID NO: 84047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcatgaaatatggtattg

SEQ ID NO: 84048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaataaaaaaaaacaagt

SEQ ID NO: 84049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcctgaaaaataaaaaaaa

SEQ ID NO: 84050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagatcaaaatatgcaatct

SEQ ID NO: 84051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagttgtagatcaaaatat

SEQ ID NO: 84052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagttgtagatcaaaata

SEQ ID NO: 84053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagttgtagatcaaaat

SEQ ID NO: 84054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaagttgtagatcaaaa

SEQ ID NO: 84055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagtggaaaatatttttaa

SEQ ID NO: 84056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcagtggaaaatattttta

SEQ ID NO: 84057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcagtggaaaatattttt

SEQ ID NO: 84058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttgtcagtggaaaatatt

SEQ ID NO: 84059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttgtcagtggaaaata

SEQ ID NO: 84060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgacaatgttctgttttgt

SEQ ID NO: 84061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagaagggaataaaaattc

SEQ ID NO: 84062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgcactcaaagaagggaa

SEQ ID NO: 84063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggaacaggagaaattata

SEQ ID NO: 84064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggaacaggagaaattat

SEQ ID NO: 84065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatggaacaggagaaatta

SEQ ID NO: 84066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcctttaatggaacaggag

SEQ ID NO: 84067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcctttaatggaacagga

SEQ ID NO: 84068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagaatttgatcctttaatg

SEQ ID NO: 84069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagaatttgatcctttaat

SEQ ID NO: 84070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccttgaagaatttgatcc

SEQ ID NO: 84071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcccttgaagaatttgatc

SEQ ID NO: 84072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcccttgaagaatttgat

SEQ ID NO: 84073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatgtattttatcccttga

SEQ ID NO: 84074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatgtattttatcccttg

SEQ ID NO: 84075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaatgtattttatccctt

SEQ ID NO: 84076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgagtatattttgaaat

SEQ ID NO: 84077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcatgagtatattttgaaa

SEQ ID NO: 84078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttgtcatgagtatattt

SEQ ID NO: 84079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatttgtcatgagtatatt

SEQ ID NO: 84080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatttgtcatgagtatat

SEQ ID NO: 84081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacatttgtcatgagtata

SEQ ID NO: 84082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttacatttgtcatgagt

SEQ ID NO: 84083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtggataattatttttac

SEQ ID NO: 84084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggacagggaaaaagtccgt

SEQ ID NO: 84085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggacagggaaaaagtccg

SEQ ID NO: 84086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaggaacaacacaacttag

SEQ ID NO: 84087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaggaacaacacaactta

SEQ ID NO: 84088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagaggaacaacacaactt

SEQ ID NO: 84089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttaagaggaacaacacaa

SEQ ID NO: 84090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgccaaggctgttttaag

SEQ ID NO: 84091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatgccaaggctgttttaa

SEQ ID NO: 84092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccttgtatgccaaggctg

SEQ ID NO: 84093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcccttgtatgccaaggct

SEQ ID NO: 84094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagataaaatggatgaaaag

SEQ ID NO: 84095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtattaaagataaaatg

SEQ ID NO: 84096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaatgtattaaagataaa

SEQ ID NO: 84097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaagagttgttgaatgtat

SEQ ID NO: 84098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaagagttgttgaatgta

SEQ ID NO: 84099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttacaaagagttgttgaat

SEQ ID NO: 84100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattgcttacaaagagttgt

SEQ ID NO: 84101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgccctccattgcttacaa

SEQ ID NO: 84102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgatgccctccattgctt

SEQ ID NO: 84103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaattgatgccctccattg

SEQ ID NO: 84104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagaagagtaaacattgtt

SEQ ID NO: 84105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagaagagtaaacattgt

SEQ ID NO: 84106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcaatttgaaagaagagta

SEQ ID NO: 84107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaataggattatgcaattt

SEQ ID NO: 84108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaataggattatgcaatt

SEQ ID NO: 84109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagcaataggattatgcaat

SEQ ID NO: 84110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagcaataggattatgcaa

SEQ ID NO: 84111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catatcttttagcaatagga

SEQ ID NO: 84112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagcattccatatctttta

SEQ ID NO: 84113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcatagcattccatatctt

SEQ ID NO: 84114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctcatagcattccatatct

SEQ ID NO: 84115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctcatagcattccatat

SEQ ID NO: 84116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgctcatagcattccata

SEQ ID NO: 84117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcttgctcatagcattcc

SEQ ID NO: 84118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttcttgctcatagcattc

SEQ ID NO: 84119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttatttcttgctcatagca

SEQ ID NO: 84120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaaagactacttatttct

SEQ ID NO: 84121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataacccattgagtaaag

SEQ ID NO: 84122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataacccattgagtaaa

SEQ ID NO: 84123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataacccattgagtaa

SEQ ID NO: 84124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaataacccattgagta

SEQ ID NO: 84125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttttaaaataacccattg

SEQ ID NO: 84126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgacttttaaaataaccca

SEQ ID NO: 84127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgacttttaaaataaccc

SEQ ID NO: 84128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgctgacttttaaaataac

SEQ ID NO: 84129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaattcttgctgactttt

SEQ ID NO: 84130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaaaaggtctcacaaatt

SEQ ID NO: 84131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaagaaaaggtctcacaaa

SEQ ID NO: 84132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attctgaagaaaaggtctca

SEQ ID NO: 84133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattctgaagaaaaggtctc

SEQ ID NO: 84134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattctgaagaaaaggtct

SEQ ID NO: 84135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcaccgaaatcatacttt

SEQ ID NO: 84136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagcaccgaaatcatactt

SEQ ID NO: 84137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaagcaccgaaatcata

SEQ ID NO: 84138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaaagcaccgaaatcat

SEQ ID NO: 84139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttatttaaagcaccgaaa

SEQ ID NO: 84140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttatttaaagcaccgaa

SEQ ID NO: 84141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtttatttaaagcaccg

SEQ ID NO: 84142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagaattcttagtttattt

SEQ ID NO: 84143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagatgcagttgagagaat

SEQ ID NO: 84144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagatgcagttgagagaa

SEQ ID NO: 84145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatagatgcagttgagaga

SEQ ID NO: 84146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaatagatgcagttgaga

SEQ ID NO: 84147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttaatagatgcagttga

SEQ ID NO: 84148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctctctttaatagatgcag

SEQ ID NO: 84149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actggctctctttaatagat

SEQ ID NO: 84150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattcactggctctcttta

SEQ ID NO: 84151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaattcactggctctcttt

SEQ ID NO: 84152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaattcactggctctctt

SEQ ID NO: 84153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acattttaaaattcactggc

SEQ ID NO: 84154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacattttaaaattcactgg

SEQ ID NO: 84155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacattttaaaattcactg

SEQ ID NO: 84156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcacattttaaaattcac

SEQ ID NO: 84157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttctttcacattttaaaa

SEQ ID NO: 84158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttctttcacattttaaa

SEQ ID NO: 84159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagttctttcacattttaa

SEQ ID NO: 84160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcagttctttcacattt

SEQ ID NO: 84161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttattttcagttctttcac

SEQ ID NO: 84162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcattcgttattttcagttc

SEQ ID NO: 84163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggcattcgttattttcag

SEQ ID NO: 84164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttggcattcgttattttca

SEQ ID NO: 84165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttggcattcgttattttc

SEQ ID NO: 84166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattttgttggcattcgtt

SEQ ID NO: 84167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaattttgttggcattcgt

SEQ ID NO: 84168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaattttgttggcattcg

SEQ ID NO: 84169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtaattttgttggcattc

SEQ ID NO: 84170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaagaatttttgtaattt

SEQ ID NO: 84171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaatgaagaatttttgtaa

SEQ ID NO: 84172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaatgaagaatttttgt

SEQ ID NO: 84173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agactctactaatgaagaat

SEQ ID NO: 84174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagactctactaatgaag

SEQ ID NO: 84175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttcagactctactaatga

SEQ ID NO: 84176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgttcagactctactaa

SEQ ID NO: 84177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctgttcagactctacta

SEQ ID NO: 84178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcatttattctgttcagac

SEQ ID NO: 84179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcatttattctgttcaga

SEQ ID NO: 84180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcagcatttattctgttc

SEQ ID NO: 84181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttcagcatttattctgt

SEQ ID NO: 84182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctatttcagcatttattc

SEQ ID NO: 84183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaagaaattattctatttc

SEQ ID NO: 84184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagtaaagaaattgtcaag

SEQ ID NO: 84185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atatcagtaaagtaattgcc

SEQ ID NO: 84186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacagcatctgatatcagt

SEQ ID NO: 84187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcaaacagcatctgatatc

SEQ ID NO: 84188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgacgctgctcaaacagc

SEQ ID NO: 84189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatgacgctgctcaaaca

SEQ ID NO: 84190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatattctacatgacgctg

SEQ ID NO: 84191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccatattctacatgacgc

SEQ ID NO: 84192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgccatattctacatgacg

SEQ ID NO: 84193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctgccatattctacatga

SEQ ID NO: 84194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcttctgccatattctac

SEQ ID NO: 84195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaacagtgttgcctcttct

SEQ ID NO: 84196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagcaaagtataaatgggac

SEQ ID NO: 84197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagttaaagcaaagtataa

SEQ ID NO: 84198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaaagttaaagcaaagta

SEQ ID NO: 84199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaaagttaaagcaaagt

SEQ ID NO: 84200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataaaggtgtgatatttat

SEQ ID NO: 84201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcataaaggtgtgatattta

SEQ ID NO: 84202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggatatttgcataaaggt

SEQ ID NO: 84203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggaggtaatacaaatataa

SEQ ID NO: 84204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggaggtaatacaaatata

SEQ ID NO: 84205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggaggtaatacaaatat

SEQ ID NO: 84206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgtggaggtaatacaaa

SEQ ID NO: 84207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttgtggaggtaatacaa

SEQ ID NO: 84208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttattttgtggaggtaa

SEQ ID NO: 84209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagtcataaaaattatact

SEQ ID NO: 84210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttagtagtcataaaaatt

SEQ ID NO: 84211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgattgagttagtagtcata

SEQ ID NO: 84212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagagaccctatgattgagt

SEQ ID NO: 84213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcagagaccctatgattg

SEQ ID NO: 84214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaacaacaagaaattgtt

SEQ ID NO: 84215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagaaacaacaagaaattgt

SEQ ID NO: 84216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagatgagtcttcagaaaca

SEQ ID NO: 84217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagatgagtcttcagaaac

SEQ ID NO: 84218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacacgccttccagatgag

SEQ ID NO: 84219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtaacacgccttccagat

SEQ ID NO: 84220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaggctattgtaacacgcc

SEQ ID NO: 84221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaggctattgtaacacgc

SEQ ID NO: 84222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttacaaggctattgtaaca

SEQ ID NO: 84223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttacaaggctattgtaac

SEQ ID NO: 84224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaaaagacttgcttacaa

SEQ ID NO: 84225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcataaaaagacttgcttac

SEQ ID NO: 84226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcataaaaagacttgctta

SEQ ID NO: 84227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcataaaaagacttgctt

SEQ ID NO: 84228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gtataataattttctcataa

SEQ ID NO: 84229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcgtataataattttctca

SEQ ID NO: 84230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcgtataataattttctc

SEQ ID NO: 84231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactcgtataataattttct

SEQ ID NO: 84232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttactcgtataataattt

SEQ ID NO: 84233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggggaaaaattcctttactc

SEQ ID NO: 84234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggggaaaaattcctttact

SEQ ID NO: 84235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggcatagccatgaatgcaa

SEQ ID NO: 84236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggcatagccatgaatgca

SEQ ID NO: 84237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggcatagccatgaatgc

SEQ ID NO: 84238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggcatagccatgaatg

SEQ ID NO: 84239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatggcatagccatgaat

SEQ ID NO: 84240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttatggcatagccatgaa

SEQ ID NO: 84241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttttatggcatagccat

SEQ ID NO: 84242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttttttatggcatagcca

SEQ ID NO: 84243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacttttttatggcatagcc

SEQ ID NO: 84244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatgttttacttttttatg

SEQ ID NO: 84245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacagctcaaatgttttac

SEQ ID NO: 84246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagagattaccacagctcaa

SEQ ID NO: 84247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttacagagattaccacagct

SEQ ID NO: 84248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgttacagagattaccaca

SEQ ID NO: 84249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgttacagagattaccac

SEQ ID NO: 84250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catttactgttacagagatt

SEQ ID NO: 84251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataactccatttactgtt

SEQ ID NO: 84252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccgtaataaaaattagaata

SEQ ID NO: 84253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgccgtaataaaaattaga

SEQ ID NO: 84254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggacaaaatctactgccg

SEQ ID NO: 84255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgctataggacaaaatcta

SEQ ID NO: 84256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtgctataggacaaaatc

SEQ ID NO: 84257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagtgctataggacaaaat

SEQ ID NO: 84258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctagtgctataggacaaaa

SEQ ID NO: 84259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taagtaaattttctagtgct

SEQ ID NO: 84260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcaaaattgtaagtaaat

SEQ ID NO: 84261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgcaaaattgtaagtaaa

SEQ ID NO: 84262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgcaaaattgtaagtaa

SEQ ID NO: 84263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgcaaaattgtaagta

SEQ ID NO: 84264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatgcaaaattgtaagt

SEQ ID NO: 84265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagtattttttaatgcaaa

SEQ ID NO: 84266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctacaagtattttttaat

SEQ ID NO: 84267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgtgctacaagtatttt

SEQ ID NO: 84268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattgtgctacaagtattt

SEQ ID NO: 84269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgaattgtgctacaagt

SEQ ID NO: 84270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttgaattgtgctacaag

SEQ ID NO: 84271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatgacttaatttgaattg

SEQ ID NO: 84272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctcacatgacttaatttg

SEQ ID NO: 84273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctcacatgacttaattt

SEQ ID NO: 84274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagctcacatgacttaatt

SEQ ID NO: 84275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatcatacaaggttttaa

SEQ ID NO: 84276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatatcatacaaggtttta

SEQ ID NO: 84277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtatatcatacaaggtttt

SEQ ID NO: 84278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactttgtatatcatacaag

SEQ ID NO: 84279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccactttgtatatcatacaa

SEQ ID NO: 84280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttccactttgtatatcat

SEQ ID NO: 84281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagcacaagttgtcttccac

SEQ ID NO: 84282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatgaagaagataaaataa

SEQ ID NO: 84283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagaaattcagatgaagaa

SEQ ID NO: 84284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaaagaaattcagatgaa

SEQ ID NO: 84285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgaaagaaattcagatga

SEQ ID NO: 84286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taccaaagaaagtaataaaa

SEQ ID NO: 84287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaccaaagaaagtaataaa

SEQ ID NO: 84288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacttgtaccaaagaaagta

SEQ ID NO: 84289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaacttgtaccaaagaaa

SEQ ID NO: 84290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcaacttgtaccaaagaa

SEQ ID NO: 84291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcaaatagatgtatgattt

SEQ ID NO: 84292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagctaagcaaatagatgt

SEQ ID NO: 84293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgtaagccagcaaatact

SEQ ID NO: 84294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatgtaagccagcaaatac

SEQ ID NO: 84295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatggtgaaaacttggat

SEQ ID NO: 84296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atattgaaaatggtgaaaac

SEQ ID NO: 84297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctaatattgaaaatggtga

SEQ ID NO: 84298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctaatattgaaaatggtg

SEQ ID NO: 84299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttagctaatattgaaaatg

SEQ ID NO: 84300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcagcatacaattgtttag

SEQ ID NO: 84301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcagcatacaattgttta

SEQ ID NO: 84302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgcagcatacaattgttt

SEQ ID NO: 84303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgtgcagcatacaattgt

SEQ ID NO: 84304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagctctttgtgcagcatac

SEQ ID NO: 84305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagctctttgtgcagcata

SEQ ID NO: 84306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagctctttgtgcagcat

SEQ ID NO: 84307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaagctctttgtgcagca

SEQ ID NO: 84308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttttgaagctctttgtgca

SEQ ID NO: 84309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaaagaaaaactcctttt

SEQ ID NO: 84310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaacaatggatgtgcatta

SEQ ID NO: 84311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaacaatggatgtgcatt

SEQ ID NO: 84312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgaacaatggatgtgcat

SEQ ID NO: 84313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgataaattttatgaacaat

SEQ ID NO: 84314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgataaattttatgaacaa

SEQ ID NO: 84315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgataaattttatgaaca

SEQ ID NO: 84316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaatgtcaaaatgcaagt

SEQ ID NO: 84317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtagaagtaaactcaaaaa

SEQ ID NO: 84318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtagaagtaaactcaaaa

SEQ ID NO: 84319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtgtagaagtaaactca

SEQ ID NO: 84320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtgtagaagtaaactc

SEQ ID NO: 84321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgtgtagaagtaaact

SEQ ID NO: 84322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttgtgtagaagtaaac

SEQ ID NO: 84323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttgtgtagaagtaaa

SEQ ID NO: 84324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatccattttttatttgtg

SEQ ID NO: 84325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaatatccattttttattt

SEQ ID NO: 84326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtcaattactaatatccat

SEQ ID NO: 84327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgggtcaattactaatatc

SEQ ID NO: 84328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattcctgggtcaattacta

SEQ ID NO: 84329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattcctgggtcaattact

SEQ ID NO: 84330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattcctgggtcaattac

SEQ ID NO: 84331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaattcctgggtcaatta

SEQ ID NO: 84332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatcttttcaattcctgggt

SEQ ID NO: 84333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaattcaatcttttcaat

SEQ ID NO: 84334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgagattatcaaattcaatc

SEQ ID NO: 84335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagtgacaaagctgtgaga

SEQ ID NO: 84336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgagtgactgacagtgacaa

SEQ ID NO: 84337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacctgtgagtgactgacag

SEQ ID NO: 84338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacctgtgagtgactgaca

SEQ ID NO: 84339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagtttgtacctgtgagtg

SEQ ID NO: 84340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatgagtttgtacctgtg

SEQ ID NO: 84341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttatgagtttgtacctgt

SEQ ID NO: 84342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttagttatgagtttgta

SEQ ID NO: 84343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtttagttatgagtttgt

SEQ ID NO: 84344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatgtttagttatgagtt

SEQ ID NO: 84345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttatgtttagttatgagt

SEQ ID NO: 84346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtttatgtttagttatga

SEQ ID NO: 84347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactcttgtttatgtttagt

SEQ ID NO: 84348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcaactcttgtttatgtt

SEQ ID NO: 84349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggctcaactcttgttta

SEQ ID NO: 84350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattggctcaactcttgttt

SEQ ID NO: 84351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattggctcaactcttgtt

SEQ ID NO: 84352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatcctttcattggctcaa

SEQ ID NO: 84353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatcctttcattggctca

SEQ ID NO: 84354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaagtttgcaatcctttca

SEQ ID NO: 84355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagttcacaagtttgcaat

SEQ ID NO: 84356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaagttcacaagtttgc

SEQ ID NO: 84357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtaagttcacaagtttg

SEQ ID NO: 84358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttactgtaagttcacaa

SEQ ID NO: 84359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcaatttactgtaagttc

SEQ ID NO: 84360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttcaatttactgtaagtt

SEQ ID NO: 84361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatccaatatttagttcaa

SEQ ID NO: 84362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcatccaatatttagttca

SEQ ID NO: 84363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcatccaatatttagttc

SEQ ID NO: 84364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggcatccaatatttagtt

SEQ ID NO: 84365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatttttggcatccaatatt

SEQ ID NO: 84366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatttttggcatccaatat

SEQ ID NO: 84367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaaacagaacgtttagatt

SEQ ID NO: 84368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggcaaacagaacgtttag

SEQ ID NO: 84369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctggcaaacagaacgttta

SEQ ID NO: 84370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgctggcaaacagaacgtt

SEQ ID NO: 84371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgctggcaaacagaacg

SEQ ID NO: 84372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcttgctggcaaacagaa

SEQ ID NO: 84373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaatacagttctctcttg

SEQ ID NO: 84374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcacaaatacagttctctct

SEQ ID NO: 84375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctctcacaaatacagttct

SEQ ID NO: 84376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctctcacaaatacagttc

SEQ ID NO: 84377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggaacttatctctcacaa

SEQ ID NO: 84378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttccaggaacttatctctca

SEQ ID NO: 84379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttccaggaacttatctctc

SEQ ID NO: 84380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttccaggaacttatctct

SEQ ID NO: 84381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggctttgttccaggaactt

SEQ ID NO: 84382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataatgtcagctgtggctt

SEQ ID NO: 84383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atataatgtcagctgtggct

SEQ ID NO: 84384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccaaaccttatataatgtc

SEQ ID NO: 84385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccaaaccttatataatgt

SEQ ID NO: 84386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacatttccccaaaccttat

SEQ ID NO: 84387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcacatttccccaaacctt

SEQ ID NO: 84388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacactctgcacatttcccc

SEQ ID NO: 84389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaacactctgcacatttcc

SEQ ID NO: 84390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtctctaaacactctgcac

SEQ ID NO: 84391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtctctaaacactctgca

SEQ ID NO: 84392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagtccttgagtctctaaa

SEQ ID NO: 84393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acacagctggaagtccttga

SEQ ID NO: 84394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtgtccacactaacacag

SEQ ID NO: 84395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccagtgtccacactaaca

SEQ ID NO: 84396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actccagtgtccacactaac

SEQ ID NO: 84397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaggtcaacggcagtctta

SEQ ID NO: 84398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaggtcaacggcagtctt

SEQ ID NO: 84399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaatttagaaggtcaacg

SEQ ID NO: 84400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaatttagaaggtcaac

SEQ ID NO: 84401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgaccatgtttccaaaatt

SEQ ID NO: 84402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagtgaccatgtttccaaaa

SEQ ID NO: 84403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagaacagccaatcagtaag

SEQ ID NO: 84404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggtgctagagaacagccaa

SEQ ID NO: 84405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccctatggtgctagagaac

SEQ ID NO: 84406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagtgcctgcccctatggt

SEQ ID NO: 84407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagtcccgaacatcaccct

SEQ ID NO: 84408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgataaactcccagtcccg

SEQ ID NO: 84409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaatgataaactcccagtc

SEQ ID NO: 84410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagtctgctaatgataaac

SEQ ID NO: 84411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagtctgctaatgataaa

SEQ ID NO: 84412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaagtctgctaatgataa

SEQ ID NO: 84413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaaagtctgctaatgata

SEQ ID NO: 84414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaagtgaaggccagtccaa

SEQ ID NO: 84415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagttagcaagtgaaggcc

SEQ ID NO: 84416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaagttagcaagtgaagg

SEQ ID NO: 84417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgaaagttagcaagtgaag

SEQ ID NO: 84418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcttctgaaagttagcaag

SEQ ID NO: 84419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtaactatgcttctgaaa

SEQ ID NO: 84420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actccagtaactatgcttct

SEQ ID NO: 84421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcactccagtaactatgc

SEQ ID NO: 84422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaataaaccagtcaataac

SEQ ID NO: 84423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaaataaaccagtcaata

SEQ ID NO: 84424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaaaataaaccagtcaat

SEQ ID NO: 84425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtggccatgtttctgaaa

SEQ ID NO: 84426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attccagtggccatgtttct

SEQ ID NO: 84427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattccagtggccatgttt

SEQ ID NO: 84428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaattctcattccagtgg

SEQ ID NO: 84429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatctgtgaaattctcattc

SEQ ID NO: 84430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaatcagctaaatctgtga

SEQ ID NO: 84431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaaaatcagctaaatctgt

SEQ ID NO: 84432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaatcagtacacaggctct

SEQ ID NO: 84433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcagaatcagtacacagg

SEQ ID NO: 84434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattaactcagaatcagta

SEQ ID NO: 84435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcattaactcagaatcagt

SEQ ID NO: 84436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatcattaactcagaatc

SEQ ID NO: 84437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaacaggtaatcatcatta

SEQ ID NO: 84438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagttgtgaacaggtaatca

SEQ ID NO: 84439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagttgtgaacaggtaatc

SEQ ID NO: 84440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcccaagtttcaagttgtg

SEQ ID NO: 84441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagcccaagtttcaagttgt

SEQ ID NO: 84442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagcccaagtttcaagttg

SEQ ID NO: 84443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaaaggaaaagaatggtc

SEQ ID NO: 84444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattcaagaaaggaaaaga

SEQ ID NO: 84445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catattcaagaaaggaaaag

SEQ ID NO: 84446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatattcaagaaaggaaaa

SEQ ID NO: 84447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatattcaagaaaggaaa

SEQ ID NO: 84448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcatattcaagaaagg

SEQ ID NO: 84449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttttcatattcaagaaag

SEQ ID NO: 84450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcttatttttcatattcaa

SEQ ID NO: 84451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agactgtgcttatttttcat

SEQ ID NO: 84452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacatgctcagactgtgctt

SEQ ID NO: 84453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtacatgctcagactgtgc

SEQ ID NO: 84454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaataatgacaagaaaaa

SEQ ID NO: 84455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaggaaataatgacaaga

SEQ ID NO: 84456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattcattaggaaataatga

SEQ ID NO: 84457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcattcattaggaaataat

SEQ ID NO: 84458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgcattcattaggaaat

SEQ ID NO: 84459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttattctgcattcattagga

SEQ ID NO: 84460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttattctgcattcatta

SEQ ID NO: 84461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccaatgtaattgttgtta

SEQ ID NO: 84462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatacctaatccaatgtaa

SEQ ID NO: 84463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatacctaatccaatgta

SEQ ID NO: 84464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttataatacctaatccaat

SEQ ID NO: 84465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattacttataatacctaat

SEQ ID NO: 84466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagattacttataataccta

SEQ ID NO: 84467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcatctctagattactta

SEQ ID NO: 84468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcatctctagattactt

SEQ ID NO: 84469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatcatctctagattact

SEQ ID NO: 84470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccgtatactttaaatcatct

SEQ ID NO: 84471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatcctaccgtatacttta

SEQ ID NO: 84472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcacatcctaccgtatact

SEQ ID NO: 84473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacataatctattcacatcc

SEQ ID NO: 84474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacataatctattcacatc

SEQ ID NO: 84475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataaaatggtgtaacattt

SEQ ID NO: 84476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acataaaatggtgtaacatt

SEQ ID NO: 84477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacataaaatggtgtaacat

SEQ ID NO: 84478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacataaaatggtgtaac

SEQ ID NO: 84479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagttctttacataaaatgg

SEQ ID NO: 84480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagatgctcaagttctttac

SEQ ID NO: 84481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatctggagatgctcaagt

SEQ ID NO: 84482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgagatactgaaatctgga

SEQ ID NO: 84483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggacctcatgagatactgaa

SEQ ID NO: 84484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggacctcatgagatactg

SEQ ID NO: 84485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttctaggacctcatgagat

SEQ ID NO: 84486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtatcagtgagggattggt

SEQ ID NO: 84487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccctcagtatcagtgaggg

SEQ ID NO: 84488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattgtccctcagtatcag

SEQ ID NO: 84489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattacaattgtccctcag

SEQ ID NO: 84490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agggaacaccaaaagcacag

SEQ ID NO: 84491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctaagggaacaccaaaagc

SEQ ID NO: 84492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctaagggaacaccaaaag

SEQ ID NO: 84493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaggtttggctaagggaac

SEQ ID NO: 84494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagcaggtttggctaaggga

SEQ ID NO: 84495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagcaggtttggctaaggg

SEQ ID NO: 84496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctagcaggtttggctaagg

SEQ ID NO: 84497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctagcaggtttggctaa

SEQ ID NO: 84498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcctctttctagcaggtttg

SEQ ID NO: 84499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatccctatcctctttcta

SEQ ID NO: 84500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatccctatcctctttct

SEQ ID NO: 84501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacaatccctatcctctttc

SEQ ID NO: 84502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaatgagaatctttacaat

SEQ ID NO: 84503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacaaatgagaatctttaca

SEQ ID NO: 84504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctctacaaatgagaatctt

SEQ ID NO: 84505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctctacaaatgagaatct

SEQ ID NO: 84506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaaaatgtttacctctac

SEQ ID NO: 84507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgccaacattagccaaaa

SEQ ID NO: 84508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatgccaacattagccaaa

SEQ ID NO: 84509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcgcttaaatgccaacat

SEQ ID NO: 84510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgattaaatcgcttaaatg

SEQ ID NO: 84511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgacagtaattggtgattaa

SEQ ID NO: 84512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcgacagtaattggtgatt

SEQ ID NO: 84513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcgacagtaattggtgat

SEQ ID NO: 84514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcgacagtaattggtga

SEQ ID NO: 84515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgcgacagtaattggtg

SEQ ID NO: 84516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagccatttttctgcgacag

SEQ ID NO: 84517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagttggagccatttttct

SEQ ID NO: 84518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagttggagccatttttc

SEQ ID NO: 84519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaatttgacagttggag

SEQ ID NO: 84520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataaattacaaaaatttga

SEQ ID NO: 84521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caataaattacaaaaatttg

SEQ ID NO: 84522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaataaattacaaaaattt

SEQ ID NO: 84523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaataaattacaaaaatt

SEQ ID NO: 84524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaataaattacaaaaat

SEQ ID NO: 84525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcaataaattacaaaaa

SEQ ID NO: 84526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttttttcaataaattaca

SEQ ID NO: 84527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcttttttcaataaattac

SEQ ID NO: 84528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcttagcttttttcaata

SEQ ID NO: 84529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtatcttagcttttttca

SEQ ID NO: 84530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgtatcttagcttttttc

SEQ ID NO: 84531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatttcctgtatcttagctt

SEQ ID NO: 84532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaagacagcctaaatttcc

SEQ ID NO: 84533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaagacagcctaaatttc

SEQ ID NO: 84534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcaagacagcctaaattt

SEQ ID NO: 84535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctttgtcaagacagcctaa

SEQ ID NO: 84536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggctttgtcaagacagcc

SEQ ID NO: 84537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attggctttgtcaagacagc

SEQ ID NO: 84538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattggctttgtcaagacag

SEQ ID NO: 84539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caccctttattggctttgtc

SEQ ID NO: 84540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctgcaccctttattggct

SEQ ID NO: 84541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcctgcaccctttattggc

SEQ ID NO: 84542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcctgcaccctttattgg

SEQ ID NO: 84543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaaatgtatgtaatgattt

SEQ ID NO: 84544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacagtatatgaaactagga

SEQ ID NO: 84545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgagggaggagagtccg

SEQ ID NO: 84546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgttcccatgagggagga

SEQ ID NO: 84547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccatgttcccatgaggga

SEQ ID NO: 84548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctccatgttcccatgaggg

SEQ ID NO: 84549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctccatgttcccatgag

SEQ ID NO: 84550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcctccatgttcccatga

SEQ ID NO: 84551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccaccaggtgtccatagca

SEQ ID NO: 84552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tacccaccaggtgtccatag

SEQ ID NO: 84553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcctctacccaccaggtgtc

SEQ ID NO: 84554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcctctacccaccaggtg

SEQ ID NO: 84555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgtcctctacccaccagg

SEQ ID NO: 84556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagcctctctgtcctctac

SEQ ID NO: 84557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcagcctctctgtcctcta

SEQ ID NO: 84558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcagcctctctgtcctct

SEQ ID NO: 84559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggaactttagcagcctct

SEQ ID NO: 84560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctataggaactttagcagcc

SEQ ID NO: 84561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggggcattcctataggaact

SEQ ID NO: 84562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggggcattcctataggaac

SEQ ID NO: 84563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggggcattcctataggaa

SEQ ID NO: 84564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcgattttgggggcattcc

SEQ ID NO: 84565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatcgattttgggggcattc

SEQ ID NO: 84566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcttaatcgattttggggg

SEQ ID NO: 84567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacctcagcttaatcgattt

SEQ ID NO: 84568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacctcagcttaatcgat

SEQ ID NO: 84569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaacctcagcttaatcga

SEQ ID NO: 84570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcataggtttctcaacctc

SEQ ID NO: 84571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtctaagcataggtttct

SEQ ID NO: 84572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caggtgaaattgtggtctaa

SEQ ID NO: 84573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatggaaaaagcctccaggt

SEQ ID NO: 84574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaatggaaaaagcctcca

SEQ ID NO: 84575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcattgttaaatggaaaaag

SEQ ID NO: 84576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggaccctggcattgttaaa

SEQ ID NO: 84577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaggaccctggcattgtta

SEQ ID NO: 84578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagccaaaggagcaagtaag

SEQ ID NO: 84579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtgtaaacaaagcaatta

SEQ ID NO: 84580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagtgtaaacaaagcaatt

SEQ ID NO: 84581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggccgtttacagtgtaaac

SEQ ID NO: 84582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaggccgtttacagtgtaa

SEQ ID NO: 84583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaacccagccagcctctca

SEQ ID NO: 84584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaagatatagaactaaaaa

SEQ ID NO: 84585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagaagatatagaactaaa

SEQ ID NO: 84586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaatacctctcagaagatat

SEQ ID NO: 84587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagcctagaatacctctca

SEQ ID NO: 84588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggatatattggaagccta

SEQ ID NO: 84589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtggatatattggaagcct

SEQ ID NO: 84590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccttggtggatatattgga

SEQ ID NO: 84591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgattagccttggtggata

SEQ ID NO: 84592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaacagttagtgattagcc

SEQ ID NO: 84593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caactgaaaacagttagtga

SEQ ID NO: 84594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatgattacaactgaaaac

SEQ ID NO: 84595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatgacactggaatgattac

SEQ ID NO: 84596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcactggatgacactggaa

SEQ ID NO: 84597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatcactggatgacactgga

SEQ ID NO: 84598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagcttaatcactggatgac

SEQ ID NO: 84599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agagcttaatcactggatga

SEQ ID NO: 84600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaaggagtaccaaagctt

SEQ ID NO: 84601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgtactataaaaggagta

SEQ ID NO: 84602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaagtgtactataaaagga

SEQ ID NO: 84603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaagtgtactataaaagg

SEQ ID NO: 84604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattaagtgtactataaaag

SEQ ID NO: 84605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcacaggtatcctttatta

SEQ ID NO: 84606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caactcagcacaggtatcct

SEQ ID NO: 84607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtcaatgcccagggtcta

SEQ ID NO: 84608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatgagttagtgtcaatgc

SEQ ID NO: 84609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatgagttagtgtcaatg

SEQ ID NO: 84610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaatgagttagtgtcaat

SEQ ID NO: 84611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaataatgaaaataatcag

SEQ ID NO: 84612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaataatgaaaataatca

SEQ ID NO: 84613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaaatagtcccttaaaaa

SEQ ID NO: 84614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaggaaatagtcccttaa

SEQ ID NO: 84615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaggaaatagtccctta

SEQ ID NO: 84616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttaaggaaatagtccctt

SEQ ID NO: 84617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgttaaggaaatagtccc

SEQ ID NO: 84618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgttaaggaaatagtcc

SEQ ID NO: 84619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttgttaaggaaatagtc

SEQ ID NO: 84620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cactttctttgttaaggaaa

SEQ ID NO: 84621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccactttctttgttaagga

SEQ ID NO: 84622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctccactttctttgttaag

SEQ ID NO: 84623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctccactttctttgttaa

SEQ ID NO: 84624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctccactttctttgtta

SEQ ID NO: 84625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaccccctttctctccactt

SEQ ID NO: 84626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggaccccctttctctccac

SEQ ID NO: 84627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctggaccccctttctctc

SEQ ID NO: 84628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctctggaccccctttctct

SEQ ID NO: 84629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccttcctctggacccccttt

SEQ ID NO: 84630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatcatacatctaccttc

SEQ ID NO: 84631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaatcatacatctacctt

SEQ ID NO: 84632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcaaaatcatacatctacc

SEQ ID NO: 84633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctcttcaaaatcatacat

SEQ ID NO: 84634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatctcttcaaaatcataca

SEQ ID NO: 84635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttaatctcttcaaaatcat

SEQ ID NO: 84636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgcttaatctcttcaaaat

SEQ ID NO: 84637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgcttaatctcttcaaaa

SEQ ID NO: 84638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctgcttaatctcttcaaa

SEQ ID NO: 84639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcattttcctgcttaatct

SEQ ID NO: 84640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcattttcctgcttaatc

SEQ ID NO: 84641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaatatggacttgatcat

SEQ ID NO: 84642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaaatatggacttgatca

SEQ ID NO: 84643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaaatatggacttgatc

SEQ ID NO: 84644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgaaaagtgagttttaca

SEQ ID NO: 84645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactatgtgaaaagtgagtt

SEQ ID NO: 84646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagactatgtgaaaagtgag

SEQ ID NO: 84647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctctagactatgtgaaaa

SEQ ID NO: 84648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accctctagactatgtgaaa

SEQ ID NO: 84649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaatttaccctctagacta

SEQ ID NO: 84650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtaaatttaccctctaga

SEQ ID NO: 84651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctgtaaatttaccctcta

SEQ ID NO: 84652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgctgtaaatttaccctct

SEQ ID NO: 84653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgctgtaaatttaccctc

SEQ ID NO: 84654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaaccgatctttctgctgt

SEQ ID NO: 84655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtaaccgatctttctgctg

SEQ ID NO: 84656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttggtaaccgatctttct

SEQ ID NO: 84657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcacttggtaaccgatctt

SEQ ID NO: 84658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcacttggtaaccgatct

SEQ ID NO: 84659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcacttggtaaccgatc

SEQ ID NO: 84660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catacccccaccaatcatat

SEQ ID NO: 84661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatacccccaccaatcata

SEQ ID NO: 84662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatatgtttccataccccca

SEQ ID NO: 84663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacctcaatatgtttccata

SEQ ID NO: 84664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgtaaccacatacctat

SEQ ID NO: 84665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatgtaaccacataccta

SEQ ID NO: 84666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaatgtaaccacatacct

SEQ ID NO: 84667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttcaaatgtaaccacat

SEQ ID NO: 84668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatctttcaaatgtaacc

SEQ ID NO: 84669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattatctttcaaatgtaac

SEQ ID NO: 84670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattatctttcaaatgtaa

SEQ ID NO: 84671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcctttcattatctttca

SEQ ID NO: 84672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagcctttcattatctttc

SEQ ID NO: 84673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccatttccagcctttcatta

SEQ ID NO: 84674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactgccatttccagccttt

SEQ ID NO: 84675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatcccgagttcaactgcc

SEQ ID NO: 84676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaatcccgagttcaactg

SEQ ID NO: 84677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggaatcccgagttcaact

SEQ ID NO: 84678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttctggaatcccgagttc

SEQ ID NO: 84679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctcacttctggaatcccg

SEQ ID NO: 84680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgctcatctcacttctgg

SEQ ID NO: 84681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatgctcatctcacttctg

SEQ ID NO: 84682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagtaatcttggatgctca

SEQ ID NO: 84683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaggccaagtcagatacct

SEQ ID NO: 84684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcaggccaagtcagatacc

SEQ ID NO: 84685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttggcaggccaagtcaga

SEQ ID NO: 84686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtattaacttggcaggcc

SEQ ID NO: 84687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataagaaatcactggagtat

SEQ ID NO: 84688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcataagaaatcactggagt

SEQ ID NO: 84689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctcataagaaatcactgg

SEQ ID NO: 84690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctctcataagaaatcactg

SEQ ID NO: 84691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttcctctcataagaaatc

SEQ ID NO: 84692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctagtttcctctcataagaa

SEQ ID NO: 84693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcctcctagtttcctctca

SEQ ID NO: 84694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcctcatcctcctagtttc

SEQ ID NO: 84695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagcctcatcctcctagttt

SEQ ID NO: 84696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagcctcatcctcctagtt

SEQ ID NO: 84697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaagcctcatcctcctag

SEQ ID NO: 84698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctttaagcctcatcctcc

SEQ ID NO: 84699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgttctttaagcctcatc

SEQ ID NO: 84700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgttctttaagcctcat

SEQ ID NO: 84701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccctgttctttaagcctc

SEQ ID NO: 84702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttccctgttctttaagcct

SEQ ID NO: 84703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttccctgttctttaagcc

SEQ ID NO: 84704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttccctgttctttaagc

SEQ ID NO: 84705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttttcttccctgttct

SEQ ID NO: 84706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcatttttcttccctgttc

SEQ ID NO: 84707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatttatcatttttcttccc

SEQ ID NO: 84708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacacaggatgtccaaaat

SEQ ID NO: 84709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggcatctcaaacacagg

SEQ ID NO: 84710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtctcccaggcatctcaaa

SEQ ID NO: 84711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtctcccaggcatctcaa

SEQ ID NO: 84712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtctcccaggcatctca

SEQ ID NO: 84713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttgtgtctcccaggcatc

SEQ ID NO: 84714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctactttgtgtctcccagg

SEQ ID NO: 84715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacctgtctactttgtgtct

SEQ ID NO: 84716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggacctgtctactttgtg

SEQ ID NO: 84717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attggacctgtctactttgt

SEQ ID NO: 84718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttattggacctgtctactt

SEQ ID NO: 84719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctacttattggacctgtct

SEQ ID NO: 84720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagagtaacatggttagcta

SEQ ID NO: 84721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttccagagtaacatggtt

SEQ ID NO: 84722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttccagagtaacatggt

SEQ ID NO: 84723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagttccagagtaacatgg

SEQ ID NO: 84724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccattttaagttccagagta

SEQ ID NO: 84725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caacccagcctcccatttta

SEQ ID NO: 84726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaacccagcctcccatttt

SEQ ID NO: 84727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttccaacccagcctcccat

SEQ ID NO: 84728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatttccaacccagcctcc

SEQ ID NO: 84729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaagttactatttccaacc

SEQ ID NO: 84730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgtctccaaagttactatt

SEQ ID NO: 84731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgctggtgtctccaaagt

SEQ ID NO: 84732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgctggtgtctccaaag

SEQ ID NO: 84733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatgctggtgtctccaaa

SEQ ID NO: 84734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttatatgctggtgtctcca

SEQ ID NO: 84735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaatgtcaaaatactctt

SEQ ID NO: 84736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgggcaatgtcaaaatact

SEQ ID NO: 84737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaatattcctgggcaatgt

SEQ ID NO: 84738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggactaggaatattcctggg

SEQ ID NO: 84739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggactaggaatattcctgg

SEQ ID NO: 84740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgggactaggaatattcct

SEQ ID NO: 84741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctcttgggactaggaata

SEQ ID NO: 84742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaccattagcctcttggg

SEQ ID NO: 84743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaaccattagcctcttgg

SEQ ID NO: 84744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaaaaccattagcctctt

SEQ ID NO: 84745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaaaaccattagcctct

SEQ ID NO: 84746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttaaaaaccattagcctc

SEQ ID NO: 84747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtacacgtctttcttaaaa

SEQ ID NO: 84748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtacacgtctttcttaaa

SEQ ID NO: 84749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatcatttatgtacacgtc

SEQ ID NO: 84750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tactatgatcatttatgtac

SEQ ID NO: 84751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtactatgatcatttatgta

SEQ ID NO: 84752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtactatgatcatttatgt

SEQ ID NO: 84753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatgttttgtactatgatc

SEQ ID NO: 84754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccatgttttgtactatgat

SEQ ID NO: 84755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccatgttttgtactatga

SEQ ID NO: 84756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttgccatgttttgtacta

SEQ ID NO: 84757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagctgttttgccatgtttt

SEQ ID NO: 84758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattcaagctgttttgccat

SEQ ID NO: 84759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccattcaagctgttttgcca

SEQ ID NO: 84760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatacttccattcaagctg

SEQ ID NO: 84761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatacttccattcaagct

SEQ ID NO: 84762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatacttccattcaagc

SEQ ID NO: 84763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaatacttccattcaag

SEQ ID NO: 84764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaggtacttttaaaatact

SEQ ID NO: 84765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaggtacttttaaaatac

SEQ ID NO: 84766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttccaaggtacttttaa

SEQ ID NO: 84767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtttccaaggtactttta

SEQ ID NO: 84768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accccttgtgtttccaaggt

SEQ ID NO: 84769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaccccttgtgtttccaag

SEQ ID NO: 84770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaccccttgtgtttccaa

SEQ ID NO: 84771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaccaatttctaacccctt

SEQ ID NO: 84772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taccagctcaaaccaatttc

SEQ ID NO: 84773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctataccagctcaaaccaat

SEQ ID NO: 84774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctataccagctcaaaccaa

SEQ ID NO: 84775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctataccagctcaaacca

SEQ ID NO: 84776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcctataccagctcaaac

SEQ ID NO: 84777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttcctataccagctcaaa

SEQ ID NO: 84778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctttcctataccagctc

SEQ ID NO: 84779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctttcctataccagct

SEQ ID NO: 84780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttctttcctataccagc

SEQ ID NO: 84781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactttccttctttcctata

SEQ ID NO: 84782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caactcaactttccttcttt

SEQ ID NO: 84783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattccaactcaactttcct

SEQ ID NO: 84784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgaattccaactcaacttt

SEQ ID NO: 84785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatatacatacgaccata

SEQ ID NO: 84786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaatatacatacgaccat

SEQ ID NO: 84787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaaatatacatacgacca

SEQ ID NO: 84788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcctttagaaatatacata

SEQ ID NO: 84789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcctttagaaatatacat

SEQ ID NO: 84790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagcctttagaaatataca

SEQ ID NO: 84791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagcctttagaaatatac

SEQ ID NO: 84792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacttttcagcctttagaaa

SEQ ID NO: 84793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcacttttcagcctttagaa

SEQ ID NO: 84794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttgcacttttcagccttt

SEQ ID NO: 84795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagaaggtagcctggctt

SEQ ID NO: 84796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gattaaaaagaaggtagcct

SEQ ID NO: 84797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagtctggattaaaaagaag

SEQ ID NO: 84798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgttggagtctggattaa

SEQ ID NO: 84799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtgttggagtctggatta

SEQ ID NO: 84800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtgttggagtctggatt

SEQ ID NO: 84801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagtgttggagtctggat

SEQ ID NO: 84802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcttttcagtgttggagtct

SEQ ID NO: 84803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggtgacctagcttttcagt

SEQ ID NO: 84804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actaaggtgacctagctttt

SEQ ID NO: 84805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactaaggtgacctagcttt

SEQ ID NO: 84806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaacttaactaaggtgac

SEQ ID NO: 84807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatacacagttaagtaact

SEQ ID NO: 84808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccgatgagtaaactgagata

SEQ ID NO: 84809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accgatgagtaaactgagat

SEQ ID NO: 84810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccgatgagtaaactgaga

SEQ ID NO: 84811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attttaccgatgagtaaact

SEQ ID NO: 84812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atactcattttaccgatgag

SEQ ID NO: 84813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catactcattttaccgatga

SEQ ID NO: 84814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatactcattttaccgatg

SEQ ID NO: 84815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatactcattttaccgat

SEQ ID NO: 84816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatccttttcatactcat

SEQ ID NO: 84817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatattcaaaatccttttca

SEQ ID NO: 84818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatattcaaaatccttttc

SEQ ID NO: 84819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttaaatattcaaaatcct

SEQ ID NO: 84820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcatttaaatattcaaaa

SEQ ID NO: 84821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgcattaactcatttaaa

SEQ ID NO: 84822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgcattaactcatttaa

SEQ ID NO: 84823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagtgtttatatgcattaac

SEQ ID NO: 84824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagagtgtttatatgcatta

SEQ ID NO: 84825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtatgattctagagtgtt

SEQ ID NO: 84826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttcaagtatgattctagag

SEQ ID NO: 84827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggttcaagtatgattcta

SEQ ID NO: 84828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attggttcaagtatgattct

SEQ ID NO: 84829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattggttcaagtatgatt

SEQ ID NO: 84830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttcttattggttcaagta

SEQ ID NO: 84831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataatgataataacaataat

SEQ ID NO: 84832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctaataatgataataacaa

SEQ ID NO: 84833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccctgcctaataatgataa

SEQ ID NO: 84834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actccccctgcctaataatg

SEQ ID NO: 84835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactccccctgcctaataat

SEQ ID NO: 84836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaactccccctgcctaat

SEQ ID NO: 84837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaactccccctgcctaa

SEQ ID NO: 84838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtcagtttatttaactc

SEQ ID NO: 84839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgtcagtttatttaact

SEQ ID NO: 84840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagcatttatgtgtcagttt

SEQ ID NO: 84841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagcatttatgtgtcagtt

SEQ ID NO: 84842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagcatttatgtgtcagt

SEQ ID NO: 84843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtacattttgaagcattta

SEQ ID NO: 84844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtgtacattttgaagcat

SEQ ID NO: 84845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgtgtacattttgaagca

SEQ ID NO: 84846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttgctgtgtacattttga

SEQ ID NO: 84847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacttgctgtgtacattttg

SEQ ID NO: 84848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaacttgctgtgtacatt

SEQ ID NO: 84849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttaacttgctgtgtacat

SEQ ID NO: 84850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttccttaacttgctgtgta

SEQ ID NO: 84851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttccttaacttgctgtgt

SEQ ID NO: 84852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatttccttaacttgctgt

SEQ ID NO: 84853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttatttccttaacttgctg

SEQ ID NO: 84854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttatttccttaacttgc

SEQ ID NO: 84855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaagtagtccatagacctc

SEQ ID NO: 84856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaagagtgctgccaagtag

SEQ ID NO: 84857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatcctgggaagagtgctgc

SEQ ID NO: 84858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatcctgggaagagtgctg

SEQ ID NO: 84859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtatcctgggaagagtgc

SEQ ID NO: 84860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttgtatcctgggaagagt

SEQ ID NO: 84861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcttgtatcctgggaaga

SEQ ID NO: 84862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctcttgtatcctgggaag

SEQ ID NO: 84863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttctctcttgtatcctgg

SEQ ID NO: 84864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtttctctcttgtatcct

SEQ ID NO: 84865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagctctggtttctctctt

SEQ ID NO: 84866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagctctggtttctctct

SEQ ID NO: 84867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgtttgaaagctctggtttc

SEQ ID NO: 84868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctccgtttgaaagctctggt

SEQ ID NO: 84869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcctccgtttgaaagctct

SEQ ID NO: 84870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcactactcctccgtttgaa

SEQ ID NO: 84871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatacaaggagaatgcctg

SEQ ID NO: 84872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaagactcccatacaagga

SEQ ID NO: 84873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgaaaagactcccatacaa

SEQ ID NO: 84874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaattgctgaaaagactc

SEQ ID NO: 84875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcaaaattgctgaaaaga

SEQ ID NO: 84876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catggattgctgcaaaattg

SEQ ID NO: 84877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcatggattgctgcaaaa

SEQ ID NO: 84878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgcatggattgctgcaaa

SEQ ID NO: 84879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctgcatggattgctgcaa

SEQ ID NO: 84880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catagatatgctttgctgca

SEQ ID NO: 84881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatagatatgctttgctgc

SEQ ID NO: 84882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttgcatagatatgcttt

SEQ ID NO: 84883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatttgcatagatatgctt

SEQ ID NO: 84884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgtatttgcatagatatg

SEQ ID NO: 84885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctccttgtatttgcatag

SEQ ID NO: 84886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatgtggacctcatctcctt

SEQ ID NO: 84887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcaatgtggacctcatctc

SEQ ID NO: 84888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacaactgctcaatgtgga

SEQ ID NO: 84889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagcagggcaactcccacaa

SEQ ID NO: 84890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagcagggcaactcccaca

SEQ ID NO: 84891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagcagggcaactcccac

SEQ ID NO: 84892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtgagacaagcaattttg

SEQ ID NO: 84893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataagggttcatgtgagaca

SEQ ID NO: 84894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattgataagggttcatgt

SEQ ID NO: 84895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacaattgataagggttca

SEQ ID NO: 84896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagttgttacaattgataag

SEQ ID NO: 84897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atacagagttgcagttgtta

SEQ ID NO: 84898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catacagagttgcagttgtt

SEQ ID NO: 84899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatacagagttgcagttgt

SEQ ID NO: 84900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagtgggcatgtccctttc

SEQ ID NO: 84901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtaagtgggcatgtccct

SEQ ID NO: 84902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgcagtgactcctgtaagt

SEQ ID NO: 84903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgcagtgactcctgtaag

SEQ ID NO: 84904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacccccttaatgcagtga

SEQ ID NO: 84905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaacccccttaatgcagtg

SEQ ID NO: 84906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaacccccttaatgcagt

SEQ ID NO: 84907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggaacccccttaatgca

SEQ ID NO: 84908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttggaacccccttaatgc

SEQ ID NO: 84909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttggaacccccttaatg

SEQ ID NO: 84910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatcaatgccgagggtgtca

SEQ ID NO: 84911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atataaagagcaccgaaaga

SEQ ID NO: 84912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatataaagagcaccgaaag

SEQ ID NO: 84913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatataaagagcaccgaaa

SEQ ID NO: 84914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataattttaatataaagag

SEQ ID NO: 84915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtataattttaatataaaga

SEQ ID NO: 84916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacagatagtaatagtaata

SEQ ID NO: 84917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacacatgggcgttagacag

SEQ ID NO: 84918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacacatgggcgttagaca

SEQ ID NO: 84919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacacatgggcgttagac

SEQ ID NO: 84920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtacacatgggcgttaga

SEQ ID NO: 84921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttgtacacatgggcgtt

SEQ ID NO: 84922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggagagaggagaagccaac

SEQ ID NO: 84923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaacaaataaaagttatg

SEQ ID NO: 84924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaacaaataaaagttat

SEQ ID NO: 84925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaataaaaaatttaaaaaa

SEQ ID NO: 84926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctcacaataaaaaatttaa

SEQ ID NO: 84927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taattagctcacaataaaaa

SEQ ID NO: 84928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctataattagctcacaataa

SEQ ID NO: 84929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctataattagctcacaata

SEQ ID NO: 84930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctataattagctcacaat

SEQ ID NO: 84931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttcctataattagctcac

SEQ ID NO: 84932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcctttcctataattagct

SEQ ID NO: 84933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcctttcctataattagc

SEQ ID NO: 84934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctcctttcctataattag

SEQ ID NO: 84935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctcctttcctataatta

SEQ ID NO: 84936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttgctcctttcctataa

SEQ ID NO: 84937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtactatttttgctcctttc

SEQ ID NO: 84938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtactatttttgctccttt

SEQ ID NO: 84939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggaagtggggcagggggt

SEQ ID NO: 84940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattataggaagtggggca

SEQ ID NO: 84941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaacattataggaagtggg

SEQ ID NO: 84942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataattgttaacattatag

SEQ ID NO: 84943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggttatataattgttaaca

SEQ ID NO: 84944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatggttatataattgtta

SEQ ID NO: 84945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attactatggttatataatt

SEQ ID NO: 84946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattactatggttatataat

SEQ ID NO: 84947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgattactatggttatata

SEQ ID NO: 84948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgattactatggttatat

SEQ ID NO: 84949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgattactatggttata

SEQ ID NO: 84950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttcttgattactatggt

SEQ ID NO: 84951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgttaattttcttgattac

SEQ ID NO: 84952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatagtaatatcatactgg

SEQ ID NO: 84953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caattcagatagtaatatca

SEQ ID NO: 84954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaattcagatagtaatatc

SEQ ID NO: 84955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaagatttgcaattcaga

SEQ ID NO: 84956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtaagatttgcaattcag

SEQ ID NO: 84957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgcaataaaaaatgatgt

SEQ ID NO: 84958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaggtataacaactaaat

SEQ ID NO: 84959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagataaaaagagactaatg

SEQ ID NO: 84960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgcagataaaaagagacta

SEQ ID NO: 84961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttgcagataaaaagagac

SEQ ID NO: 84962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagttctgttgcagataaaa

SEQ ID NO: 84963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaggtcacgaaagaaaaga

SEQ ID NO: 84964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccaattgtcaggtcacgaa

SEQ ID NO: 84965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcccaattgtcaggtcacg

SEQ ID NO: 84966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattctgcccaattgtcagg

SEQ ID NO: 84967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattctgcccaattgtcag

SEQ ID NO: 84968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttgtattctgcccaattg

SEQ ID NO: 84969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaataactgatttgtatt

SEQ ID NO: 84970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaaataactgatttgta

SEQ ID NO: 84971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacgcattctacaaaataa

SEQ ID NO: 84972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgaacccaagttgagacg

SEQ ID NO: 84973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaattcagtgaacccaag

SEQ ID NO: 84974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaattgaaaaattcagtga

SEQ ID NO: 84975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgtgaattgaaaaattca

SEQ ID NO: 84976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttgtgaattgaaaaattc

SEQ ID NO: 84977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttagttgtgaattgaaaaa

SEQ ID NO: 84978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttagttgtgaattgaaaa

SEQ ID NO: 84979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttccttagttgtgaattg

SEQ ID NO: 84980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttccttagttgtgaatt

SEQ ID NO: 84981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtttccttagttgtgaat

SEQ ID NO: 84982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catagataacgctttagttt

SEQ ID NO: 84983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attccatagataacgcttta

SEQ ID NO: 84984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaaagtatctaattccat

SEQ ID NO: 84985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcaaagtatctaattcca

SEQ ID NO: 84986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttgagcaaagtatctaat

SEQ ID NO: 84987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttaccttgagcaaagtat

SEQ ID NO: 84988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacacagctgtgttaccttg

SEQ ID NO: 84989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacacacagctgtgttacc

SEQ ID NO: 84990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctacacacagctgtgtta

SEQ ID NO: 84991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctctgctacacacagctgt

SEQ ID NO: 84992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatcctggctctgctacac

SEQ ID NO: 84993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcaaatcctggctctgct

SEQ ID NO: 84994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttcaaatcctggctctgc

SEQ ID NO: 84995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggagtaacagatcttagtt

SEQ ID NO: 84996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctggggagtaacagatct

SEQ ID NO: 84997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactggcctggggagtaaca

SEQ ID NO: 84998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatactggcctggggagtaa

SEQ ID NO: 84999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatactggcctggggagta

SEQ ID NO: 85000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatactggcctggggagt

SEQ ID NO: 85001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctatactggcctggggag

SEQ ID NO: 85002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctatactggcctgggga

SEQ ID NO: 85003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctatactggcctgggg

SEQ ID NO: 85004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttctatactggcctggg

SEQ ID NO: 85005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttctatactggcctgg

SEQ ID NO: 85006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttttttttctatactggc

SEQ ID NO: 85007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgttatcttttttttctat

SEQ ID NO: 85008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatgttatcttttttttct

SEQ ID NO: 85009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctaatgttatcttttttt

SEQ ID NO: 85010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctctaatgttatctttttt

SEQ ID NO: 85011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacatccttcctctaatgt

SEQ ID NO: 85012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacatccttcctctaatg

SEQ ID NO: 85013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacatccttcctctaat

SEQ ID NO: 85014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttttaaaacatccttcc

SEQ ID NO: 85015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagttttaaaacatccttc

SEQ ID NO: 85016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagttttaaaacatcctt

SEQ ID NO: 85017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattttaaagttttaaaaca

SEQ ID NO: 85018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcattttaaagttttaaaa

SEQ ID NO: 85019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcattttaaagttttaaa

SEQ ID NO: 85020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agccatgtatttctgcattt

SEQ ID NO: 85021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagccatgtatttctgcat

SEQ ID NO: 85022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caacaggtacatactctaag

SEQ ID NO: 85023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaacaggtacatactctaa

SEQ ID NO: 85024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcaacaggtacatactcta

SEQ ID NO: 85025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatgccaagacctttgcaa

SEQ ID NO: 85026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataaagccaaatgagtcat

SEQ ID NO: 85027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgaataaagccaaatgagt

SEQ ID NO: 85028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtctgctgaataaagcca

SEQ ID NO: 85029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactcaagtctgctgaataa

SEQ ID NO: 85030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaactcaagtctgctgaat

SEQ ID NO: 85031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaactcaagtctgctgaa

SEQ ID NO: 85032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttctaaactcaagtctg

SEQ ID NO: 85033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgaatttctaaactcaag

SEQ ID NO: 85034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgattgaatttctaaact

SEQ ID NO: 85035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcactgattgaatttctaa

SEQ ID NO: 85036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccagataaactactcactga

SEQ ID NO: 85037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accagataaactactcactg

SEQ ID NO: 85038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaggacagtttaccagata

SEQ ID NO: 85039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attacaaggacagtttacca

SEQ ID NO: 85040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattacaaggacagtttacc

SEQ ID NO: 85041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaattacaaggacagttt

SEQ ID NO: 85042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaattacaaggacagtt

SEQ ID NO: 85043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttaattacaaggacagt

SEQ ID NO: 85044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttatttaattacaaggac

SEQ ID NO: 85045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggattgttttatttaatta

SEQ ID NO: 85046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggggattgttttatttaa

SEQ ID NO: 85047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctggggattgttttattta

SEQ ID NO: 85048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttcctggggattgtttta

SEQ ID NO: 85049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaacttcctggggattg

SEQ ID NO: 85050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattaacttcctggggatt

SEQ ID NO: 85051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattaacttcctggggat

SEQ ID NO: 85052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaattaacttcctgggga

SEQ ID NO: 85053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaattaacttcctgggg

SEQ ID NO: 85054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcaattaacttcctggg

SEQ ID NO: 85055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgggcaggcttttttcaat

SEQ ID NO: 85056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatgggcaggcttttttc

SEQ ID NO: 85057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtgttcctgatgggcaggc

SEQ ID NO: 85058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggtgttcctgatgggcag

SEQ ID NO: 85059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaggtgttcctgatgggca

SEQ ID NO: 85060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacagaccaacaaagcgtgg

SEQ ID NO: 85061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacagaccaacaaagcgtg

SEQ ID NO: 85062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttaaacagaccaacaaag

SEQ ID NO: 85063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttaaacagaccaacaaa

SEQ ID NO: 85064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgaagagcagtgtgccagaa

SEQ ID NO: 85065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgaagagcagtgtgccaga

SEQ ID NO: 85066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttccgaagagcagtgtgc

SEQ ID NO: 85067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttccgaagagcagtgtg

SEQ ID NO: 85068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttgatttccgaagagca

SEQ ID NO: 85069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatttgatttccgaagagc

SEQ ID NO: 85070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatttgatttccgaagag

SEQ ID NO: 85071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcattttaaatttgatttcc

SEQ ID NO: 85072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgtcattttaaatttgat

SEQ ID NO: 85073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acctgtcattttaaatttga

SEQ ID NO: 85074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaccaacttacctgtcatt

SEQ ID NO: 85075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaagttaagaccaactta

SEQ ID NO: 85076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaaagttaagaccaactt

SEQ ID NO: 85077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagaaagttaagaccaact

SEQ ID NO: 85078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcctttaagaaagttaaga

SEQ ID NO: 85079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcctttaagaaagttaag

SEQ ID NO: 85080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtgcctttaagaaagtt

SEQ ID NO: 85081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttgtgcctttaagaaagt

SEQ ID NO: 85082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgtttgtgcctttaagaa

SEQ ID NO: 85083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttacttgtttgtgcctttaa

SEQ ID NO: 85084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatcagagagtcagctat

SEQ ID NO: 85085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgatacattatatatcagag

SEQ ID NO: 85086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgatacattatatatcag

SEQ ID NO: 85087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtgatacattatatatca

SEQ ID NO: 85088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtgatacattatatatc

SEQ ID NO: 85089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgtgatacattatatat

SEQ ID NO: 85090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgtgaaatcagccttttc

SEQ ID NO: 85091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaaaggccactacatgtg

SEQ ID NO: 85092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgataaaaggccactacat

SEQ ID NO: 85093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgttgataaaaggccacta

SEQ ID NO: 85094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttgctgttgataaaaggc

SEQ ID NO: 85095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaattatgttgctgttga

SEQ ID NO: 85096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaattcccaaattatgttg

SEQ ID NO: 85097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaattcccaaattatgtt

SEQ ID NO: 85098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatttagaaattcccaaa

SEQ ID NO: 85099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattaaaaatttagaaattc

SEQ ID NO: 85100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtaagatctaaattaaaa

SEQ ID NO: 85101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagtaagatctaaattaaa

SEQ ID NO: 85102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatcttaaagtaagatcta

SEQ ID NO: 85103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatcttaaagtaagatct

SEQ ID NO: 85104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatcttaaagtaagatc

SEQ ID NO: 85105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatatcttaaagtaagat

SEQ ID NO: 85106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatatcttaaagtaaga

SEQ ID NO: 85107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttttcatatcttaaagta

SEQ ID NO: 85108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctattttttcatatcttaaa

SEQ ID NO: 85109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcctattttttcatatctt

SEQ ID NO: 85110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctcctcctattttttcata

SEQ ID NO: 85111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctccctcctcctattttt

SEQ ID NO: 85112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccctccctcctcctatttt

SEQ ID NO: 85113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttcccctccctcctccta

SEQ ID NO: 85114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcttcccctccctcctcct

SEQ ID NO: 85115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccaggcatttagcttcccc

SEQ ID NO: 85116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccaggcatttagcttccc

SEQ ID NO: 85117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccccaggcatttagcttcc

SEQ ID NO: 85118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaacatgcatgtctttccc

SEQ ID NO: 85119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagaacatgcatgtctttc

SEQ ID NO: 85120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaaaattctaagaacatgc

SEQ ID NO: 85121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacaaaattctaagaacat

SEQ ID NO: 85122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattctaacaaaattctaag

SEQ ID NO: 85123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attacattctaacaaaattc

SEQ ID NO: 85124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggacatagggactcattaca

SEQ ID NO: 85125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaaatactaggacatagg

SEQ ID NO: 85126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagagggagtctataaaaa

SEQ ID NO: 85127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagttaacagagggagtcta

SEQ ID NO: 85128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatagttaacagagggag

SEQ ID NO: 85129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattcattatagttaacaga

SEQ ID NO: 85130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaattcattatagttaac

SEQ ID NO: 85131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctaaattcattatagttaa

SEQ ID NO: 85132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acccaccttcctaaattcat

SEQ ID NO: 85133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcacccaccttcctaaattc

SEQ ID NO: 85134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcacccaccttcctaaatt

SEQ ID NO: 85135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggtgaaagagaataaaaca

SEQ ID NO: 85136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggggtgaaagagaataaa

SEQ ID NO: 85137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attggggtgaaagagaataa

SEQ ID NO: 85138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatcatttattggggtgaa

SEQ ID NO: 85139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatatcatttattggggtga

SEQ ID NO: 85140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatagatgcttgatatca

SEQ ID NO: 85141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatagatgcttgatatc

SEQ ID NO: 85142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttaaatatagatgcttga

SEQ ID NO: 85143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatttaaatatagatgct

SEQ ID NO: 85144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaatttaaatatagatgc

SEQ ID NO: 85145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaatttaaatatagatg

SEQ ID NO: 85146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttaatttaaatatagat

SEQ ID NO: 85147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagtttttgttaatttaaat

SEQ ID NO: 85148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtgccagggactccagtt

SEQ ID NO: 85149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaggtgccagggactcca

SEQ ID NO: 85150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcaggtgccagggactcc

SEQ ID NO: 85151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcaagcacttgttcaggtg

SEQ ID NO: 85152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagcaagcacttgttcaggt

SEQ ID NO: 85153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgagcaagcacttgttca

SEQ ID NO: 85154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaatactgtttgagcaag

SEQ ID NO: 85155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtaattaacaaatactg

SEQ ID NO: 85156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaagtaattaacaaatact

SEQ ID NO: 85157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catttacaagtaattaacaa

SEQ ID NO: 85158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtgctacatttacaagta

SEQ ID NO: 85159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagtgctacatttacaagt

SEQ ID NO: 85160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgaagtgctacatttaca

SEQ ID NO: 85161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctccttgaagtgctacattt

SEQ ID NO: 85162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctccttgaagtgctacat

SEQ ID NO: 85163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actctcctccttgaagtgct

SEQ ID NO: 85164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaactctcctccttgaagt

SEQ ID NO: 85165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactattaactctcctcctt

SEQ ID NO: 85166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactattaactctcctcct

SEQ ID NO: 85167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatactattaactctcctcc

SEQ ID NO: 85168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtaacctttatactatta

SEQ ID NO: 85169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggtaacctttatactatt

SEQ ID NO: 85170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggtaacctttatactat

SEQ ID NO: 85171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attttaaggtaacctttata

SEQ ID NO: 85172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtctgattttaaggtaa

SEQ ID NO: 85173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagtctgattttaaggta

SEQ ID NO: 85174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttaaaagtctgattttaa

SEQ ID NO: 85175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttaaaagtctgatttta

SEQ ID NO: 85176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatttaaaagtctgatt

SEQ ID NO: 85177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catagaagttatttaattta

SEQ ID NO: 85178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacatagaagttatttaat

SEQ ID NO: 85179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caccatattattacatagaa

SEQ ID NO: 85180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaccatattattacataga

SEQ ID NO: 85181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaccatattattacatag

SEQ ID NO: 85182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttccaccatattattaca

SEQ ID NO: 85183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttccaccatattattac

SEQ ID NO: 85184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttccaccatattatta

SEQ ID NO: 85185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttattttccaccatatta

SEQ ID NO: 85186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctattttattttccacca

SEQ ID NO: 85187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatctattttattttccac

SEQ ID NO: 85188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggttctcatctattttatt

SEQ ID NO: 85189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cactaaggttctcatctatt

SEQ ID NO: 85190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacactaaggttctcatcta

SEQ ID NO: 85191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catattctacactaaggttc

SEQ ID NO: 85192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagagaaatgtcaggagaa

SEQ ID NO: 85193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaagagaaatgtcaggaga

SEQ ID NO: 85194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttcaaagagaaatgtca

SEQ ID NO: 85195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatagtagaattaaatttca

SEQ ID NO: 85196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagatagtagaattaaattt

SEQ ID NO: 85197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctagatagtagaattaaat

SEQ ID NO: 85198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctctctagatagtagaatt

SEQ ID NO: 85199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caatatgctacctctctaga

SEQ ID NO: 85200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctacaatatgctacctctct

SEQ ID NO: 85201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctacaatatgctacctctc

SEQ ID NO: 85202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatttcctacaatatgcta

SEQ ID NO: 85203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatttcctacaatatgct

SEQ ID NO: 85204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacttataatttcctacaat

SEQ ID NO: 85205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacttataatttcctacaa

SEQ ID NO: 85206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atacaagagtggtaaagcca

SEQ ID NO: 85207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggttcatacaagagtggta

SEQ ID NO: 85208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcaggttcatacaagagtg

SEQ ID NO: 85209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcaggttcatacaagagt

SEQ ID NO: 85210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcatttactcaggttcat

SEQ ID NO: 85211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggttaaatcatttactcag

SEQ ID NO: 85212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaggttaaatcatttact

SEQ ID NO: 85213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accagtgaaataggagacat

SEQ ID NO: 85214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaccagtgaaataggaga

SEQ ID NO: 85215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcaccagtgaaataggag

SEQ ID NO: 85216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccgtgtaacttcctcacca

SEQ ID NO: 85217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagactacccgtgtaactt

SEQ ID NO: 85218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taacagactacccgtgtaac

SEQ ID NO: 85219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaacagactacccgtgtaa

SEQ ID NO: 85220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctaacagactacccgtgta

SEQ ID NO: 85221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctaacagactacccgtg

SEQ ID NO: 85222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcccctctttctaacagac

SEQ ID NO: 85223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcccctctttctaacaga

SEQ ID NO: 85224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcatcccctctttctaac

SEQ ID NO: 85225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttcatcccctctttctaa

SEQ ID NO: 85226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttacttcatcccctcttt

SEQ ID NO: 85227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctgccttacttcatcccc

SEQ ID NO: 85228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcctgccttacttcatccc

SEQ ID NO: 85229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccaggtgcttgtcctgcct

SEQ ID NO: 85230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagagtaaaccctagccagg

SEQ ID NO: 85231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatactgtagagtaaaccc

SEQ ID NO: 85232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagctgtaatactgtagagt

SEQ ID NO: 85233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagctgtaatactgtagag

SEQ ID NO: 85234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagctgtaatactgtaga

SEQ ID NO: 85235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcaagctgtaatactgt

SEQ ID NO: 85236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttcaagctgtaatactg

SEQ ID NO: 85237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttttcaagctgtaatact

SEQ ID NO: 85238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgttttcaagctgtaata

SEQ ID NO: 85239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgttttcaagctgtaat

SEQ ID NO: 85240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttgttttcaagctgtaa

SEQ ID NO: 85241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctttgttttcaagctgta

SEQ ID NO: 85242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttctttgttttcaagctg

SEQ ID NO: 85243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttttctttgttttcaagc

SEQ ID NO: 85244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttttctttgttttcaag

SEQ ID NO: 85245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcttttctttgttttcaa

SEQ ID NO: 85246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctcttttctttgtttt

SEQ ID NO: 85247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttctcttttctttgttt

SEQ ID NO: 85248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatttgttttctcttttct

SEQ ID NO: 85249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatttgttttctcttttc

SEQ ID NO: 85250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttcccatttgttttctct

SEQ ID NO: 85251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggagactggtttcccattt

SEQ ID NO: 85252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaaggagactggtttccc

SEQ ID NO: 85253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattaaggagactggtttcc

SEQ ID NO: 85254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattaaggagactggtttc

SEQ ID NO: 85255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attttcattaaggagactgg

SEQ ID NO: 85256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcattttcattaaggaga

SEQ ID NO: 85257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactcattttcattaaggag

SEQ ID NO: 85258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttcactcattttcattaa

SEQ ID NO: 85259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttcactcattttcatta

SEQ ID NO: 85260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcttcactcattttcatt

SEQ ID NO: 85261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtcttcactcattttcat

SEQ ID NO: 85262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggcttttgtcttcactcat

SEQ ID NO: 85263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggcttttgtcttcactca

SEQ ID NO: 85264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaggcttttgtcttcac

SEQ ID NO: 85265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaagatgtgttatttgagg

SEQ ID NO: 85266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccaagatgtgttatttgag

SEQ ID NO: 85267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcccaagatgtgttatttg

SEQ ID NO: 85268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtacattcttcccaagatg

SEQ ID NO: 85269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagtacattcttcccaaga

SEQ ID NO: 85270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgagtacattcttcccaag

SEQ ID NO: 85271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaatttctgagtacattc

SEQ ID NO: 85272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaattataaaatttctgag

SEQ ID NO: 85273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agataattataaattataaa

SEQ ID NO: 85274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagataattataaattata

SEQ ID NO: 85275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagataattataaattat

SEQ ID NO: 85276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttctcagataattataa

SEQ ID NO: 85277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagattatatttctcagata

SEQ ID NO: 85278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagaaaacccatgtcaaat

SEQ ID NO: 85279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagaaaacccatgtcaaa

SEQ ID NO: 85280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaagaaaacccatgtcaa

SEQ ID NO: 85281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatggcatgttttgaaaga

SEQ ID NO: 85282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtaatagatatgtcaatg

SEQ ID NO: 85283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagtaatagatatgtcaat

SEQ ID NO: 85284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accttcaagtaatagatatg

SEQ ID NO: 85285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaccttcaagtaatagatat

SEQ ID NO: 85286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacttgaccttcaagtaata

SEQ ID NO: 85287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtacttgaccttcaagtaat

SEQ ID NO: 85288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaaaatgcacttgtacttg

SEQ ID NO: 85289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaaaatgcacttgtactt

SEQ ID NO: 85290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttggtaaaatgcacttgta

SEQ ID NO: 85291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatcaatgtggaaacacta

SEQ ID NO: 85292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatcaatgtggaaacact

SEQ ID NO: 85293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaatcaatgtggaaacac

SEQ ID NO: 85294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtgaaaagtagttttgcaa

SEQ ID NO: 85295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaagtaaaactgagtgaa

SEQ ID NO: 85296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaaccaagaatcagtagt

SEQ ID NO: 85297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaattcaaaaaccaagaa

SEQ ID NO: 85298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaattcaaaaaccaaga

SEQ ID NO: 85299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaattcaaaaaccaag

SEQ ID NO: 85300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaattcaaaaaccaa

SEQ ID NO: 85301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttttaaaaaattcaaaaa

SEQ ID NO: 85302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagcctgatttttaaaaaa

SEQ ID NO: 85303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgattagaagcctgatttt

SEQ ID NO: 85304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacgattagaagcctgattt

SEQ ID NO: 85305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtcttaacgattagaagcc

SEQ ID NO: 85306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggactaagtcttaacgat

SEQ ID NO: 85307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatatgattagaggactaa

SEQ ID NO: 85308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaaaaagaaagaagagaa

SEQ ID NO: 85309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgacacagaaatacacta

SEQ ID NO: 85310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagcctgggtgacacagaaa

SEQ ID NO: 85311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactacagcctgggtgacac

SEQ ID NO: 85312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgcactacagcctgggtga

SEQ ID NO: 85313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaatgcactactgcactac

SEQ ID NO: 85314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtgagctgtcaatgcact

SEQ ID NO: 85315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcccagaggtggaggctg

SEQ ID NO: 85316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatcccagaggtggaggct

SEQ ID NO: 85317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtgggagggtcacttgaa

SEQ ID NO: 85318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaggctgaggtgggagggt

SEQ ID NO: 85319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagaggctgaggtgggaggg

SEQ ID NO: 85320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgagaggctgaggtggga

SEQ ID NO: 85321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctacttgagaggctgaggt

SEQ ID NO: 85322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtcctagctacttgagag

SEQ ID NO: 85323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgcagtcctagctacttg

SEQ ID NO: 85324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggcgcctgcctgcagtcct

SEQ ID NO: 85325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccgggtgttgtggcgcctg

SEQ ID NO: 85326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agccgggtgttgtggcgcct

SEQ ID NO: 85327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaaaatagacaaaactta

SEQ ID NO: 85328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataaaaaatagacaaaact

SEQ ID NO: 85329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctataaaaaatagacaaaac

SEQ ID NO: 85330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaccagccggggcaacat

SEQ ID NO: 85331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcccaggagttcaagacca

SEQ ID NO: 85332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcccaggagttcaagacc

SEQ ID NO: 85333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtgggtggatcacttgag

SEQ ID NO: 85334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggctgaggtgggtggat

SEQ ID NO: 85335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggctgaggtgggtgga

SEQ ID NO: 85336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggctgaggtgggtgg

SEQ ID NO: 85337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatcccagcactttgggag

SEQ ID NO: 85338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcctgcaatcccagcact

SEQ ID NO: 85339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagccaggcaggacggctc

SEQ ID NO: 85340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaagccaggcaggacggct

SEQ ID NO: 85341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacatgaagaaataaacttc

SEQ ID NO: 85342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacatgaagaaataaactt

SEQ ID NO: 85343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatatatttgtacatgaag

SEQ ID NO: 85344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcatatatttgtacatgaa

SEQ ID NO: 85345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggcatatatttgtacatg

SEQ ID NO: 85346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccatattcttggcatatatt

SEQ ID NO: 85347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaataaaatatagaata

SEQ ID NO: 85348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatatcaatgcacataata

SEQ ID NO: 85349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatatcaatgcacataat

SEQ ID NO: 85350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtatatcaatgcacataa

SEQ ID NO: 85351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaatactttagtatatca

SEQ ID NO: 85352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaaatactttagtatatc

SEQ ID NO: 85353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaaaatactttagtatat

SEQ ID NO: 85354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttagaaaatactttagtat

SEQ ID NO: 85355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaggaaatagttctttag

SEQ ID NO: 85356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaggaaatagttcttta

SEQ ID NO: 85357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagatatttccaaaggaaa

SEQ ID NO: 85358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaggtaaggtcaattaag

SEQ ID NO: 85359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaaaggtaaggtcaatta

SEQ ID NO: 85360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaaaaggtaaggtcaatt

SEQ ID NO: 85361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctaaaaaggtaaggtcaa

SEQ ID NO: 85362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctaaaaaggtaaggtca

SEQ ID NO: 85363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttctaaaaaggtaaggtc

SEQ ID NO: 85364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttctaaaaaggtaaggt

SEQ ID NO: 85365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttttcttctaaaaaggt

SEQ ID NO: 85366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacttttcttctaaaaagg

SEQ ID NO: 85367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaacttttcttctaaaaag

SEQ ID NO: 85368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccagcccagttttcaactt

SEQ ID NO: 85369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttccccagcccagttttcaa

SEQ ID NO: 85370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttccccagcccagttttca

SEQ ID NO: 85371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgttccccagcccagt

SEQ ID NO: 85372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttgttccccagcccag

SEQ ID NO: 85373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccatttgttccccagccca

SEQ ID NO: 85374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttccatttgttccccagc

SEQ ID NO: 85375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttccatttgttccccag

SEQ ID NO: 85376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagcatcttattttccatt

SEQ ID NO: 85377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catacatgatagttaaaagc

SEQ ID NO: 85378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttacatacatgatagttaaa

SEQ ID NO: 85379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattacatacatgatagtta

SEQ ID NO: 85380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaatgtcactctattaca

SEQ ID NO: 85381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gacaaatgtcactctattac

SEQ ID NO: 85382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgacaaatgtcactctat

SEQ ID NO: 85383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgacaaatgtcactcta

SEQ ID NO: 85384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttgcttgacaaatgtca

SEQ ID NO: 85385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatttgcttgacaaatgtc

SEQ ID NO: 85386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgtgaaatttccatttgc

SEQ ID NO: 85387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatgtgaaatttccatttg

SEQ ID NO: 85388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaatgtgaaatttccatt

SEQ ID NO: 85389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttgaatgtgaaatttcc

SEQ ID NO: 85390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttattcttgaatgtgaaa

SEQ ID NO: 85391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagatatgtctaagttat

SEQ ID NO: 85392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accatgtcattatatagata

SEQ ID NO: 85393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaccagtgtaactcacca

SEQ ID NO: 85394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaaattataaaccagtgt

SEQ ID NO: 85395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgtgaaagagctgtgaaa

SEQ ID NO: 85396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatatgtgaaagagctgtg

SEQ ID NO: 85397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagcattgctatatgtgaaa

SEQ ID NO: 85398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagcattgctatatgtgaa

SEQ ID NO: 85399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagagcattgctatatgtga

SEQ ID NO: 85400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttagagcattgctata

SEQ ID NO: 85401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttagagcattgctat

SEQ ID NO: 85402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtttatattttagagcat

SEQ ID NO: 85403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagtttatattttagagca

SEQ ID NO: 85404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcagtttatattttagagc

SEQ ID NO: 85405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaagaaaaatgaaaggaat

SEQ ID NO: 85406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaagaaaaatgaaaggaa

SEQ ID NO: 85407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtaagaaaaatgaaagga

SEQ ID NO: 85408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatgtcacctttggtaagaa

SEQ ID NO: 85409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaatctcaatgtcaccttt

SEQ ID NO: 85410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaatctcaatgtcacctt

SEQ ID NO: 85411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaaatctcaatgtcacct

SEQ ID NO: 85412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaacaagcaccaaactttg

SEQ ID NO: 85413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtaacaagcaccaaacttt

SEQ ID NO: 85414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacatgacttggtaacaagc

SEQ ID NO: 85415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaacatgacttggtaacaag

SEQ ID NO: 85416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaaacatgacttggtaac

SEQ ID NO: 85417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttaaacatgacttggtaa

SEQ ID NO: 85418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgtttccttaaacatgac

SEQ ID NO: 85419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatgtttccttaaacatga

SEQ ID NO: 85420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcatagcttcaatgtttcc

SEQ ID NO: 85421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtcatagcttcaatgttt

SEQ ID NO: 85422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggtcatagcttcaatgtt

SEQ ID NO: 85423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acttctggtcatagcttcaa

SEQ ID NO: 85424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagcctgacttctggtcat

SEQ ID NO: 85425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagctcaaagcctgacttc

SEQ ID NO: 85426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aactcaaagctcaaagcctg

SEQ ID NO: 85427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacggtataaagtgggagaa

SEQ ID NO: 85428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agacggtataaagtgggaga

SEQ ID NO: 85429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagacggtataaagtggga

SEQ ID NO: 85430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttagacggtataaagtggg

SEQ ID NO: 85431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttagacggtataaagtgg

SEQ ID NO: 85432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttagacggtataaagtg

SEQ ID NO: 85433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttttcttagacggtataa

SEQ ID NO: 85434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaattaacttttcttaga

SEQ ID NO: 85435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcaaattaacttttctta

SEQ ID NO: 85436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatcaaattaacttttctt

SEQ ID NO: 85437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttctatcaaattaacttt

SEQ ID NO: 85438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtcttctatcaaattaa

SEQ ID NO: 85439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgtcttctatcaaatta

SEQ ID NO: 85440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattgtcttctatcaaatt

SEQ ID NO: 85441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcattgtcttctatcaaa

SEQ ID NO: 85442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaattctttcattgtcttc

SEQ ID NO: 85443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgccaattctttcattgtc

SEQ ID NO: 85444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgttgccaattctttcatt

SEQ ID NO: 85445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caggtctattgttgccaatt

SEQ ID NO: 85446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacatctgcaggtctattg

SEQ ID NO: 85447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacatctgcaggtctatt

SEQ ID NO: 85448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacatctgcaggtctat

SEQ ID NO: 85449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaacatctgcaggtcta

SEQ ID NO: 85450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgccttttaaaacatctgc

SEQ ID NO: 85451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aactagtgccttttaaaaca

SEQ ID NO: 85452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctaaactagtgccttttaa

SEQ ID NO: 85453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcatattggctaaactagt

SEQ ID NO: 85454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcatattggctaaactag

SEQ ID NO: 85455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagacccatgtacatatt

SEQ ID NO: 85456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagagacccatgtacatat

SEQ ID NO: 85457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggagtcttaaagagaccca

SEQ ID NO: 85458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggagtcttaaagagaccc

SEQ ID NO: 85459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtggagtcttaaagagacc

SEQ ID NO: 85460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgtggagtcttaaagaga

SEQ ID NO: 85461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagtgtctctttgtggagt

SEQ ID NO: 85462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcagtgtctctttgtggag

SEQ ID NO: 85463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagcagtgtctctttgtgg

SEQ ID NO: 85464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagtaactcttagcagtgtc

SEQ ID NO: 85465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagtaactcttagcagtgt

SEQ ID NO: 85466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttccagtaactcttagcag

SEQ ID NO: 85467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttccagtaactcttagca

SEQ ID NO: 85468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtttgtttccagtaactc

SEQ ID NO: 85469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagagcagctgtagtttgt

SEQ ID NO: 85470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcacagagcagctgtagtt

SEQ ID NO: 85471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcacagagcagctgtagt

SEQ ID NO: 85472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaatttattcacagagcag

SEQ ID NO: 85473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaactaagaatttattcac

SEQ ID NO: 85474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacagcaactgtgaactaa

SEQ ID NO: 85475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccacagcaactgtgaacta

SEQ ID NO: 85476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccacagcaactgtgaact

SEQ ID NO: 85477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccacagcaactgtgaac

SEQ ID NO: 85478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcccacagcaactgtgaa

SEQ ID NO: 85479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttttcccacagcaactg

SEQ ID NO: 85480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttttcccacagcaact

SEQ ID NO: 85481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattttttcccacagcaac

SEQ ID NO: 85482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatctttcattttttcccac

SEQ ID NO: 85483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taattggatctttcattttt

SEQ ID NO: 85484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaattggatctttcatttt

SEQ ID NO: 85485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaattggatctttcattt

SEQ ID NO: 85486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagactttgtaattggatc

SEQ ID NO: 85487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggaaatctcccagacttt

SEQ ID NO: 85488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attataggaaatctcccaga

SEQ ID NO: 85489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcatagcaaaagtaatat

SEQ ID NO: 85490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tactgtgtcatagcaaaagt

SEQ ID NO: 85491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtactgtgtcatagcaaaa

SEQ ID NO: 85492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtactgtgtcatagcaaa

SEQ ID NO: 85493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgtactgtgtcatagca

SEQ ID NO: 85494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttctgtactgtgtcatagc

SEQ ID NO: 85495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttctgtactgtgtcatag

SEQ ID NO: 85496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttcttctgtactgtgtca

SEQ ID NO: 85497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttcttctgtactgtgtc

SEQ ID NO: 85498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctttcttctgtactgtgt

SEQ ID NO: 85499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctttcttctgtactgtg

SEQ ID NO: 85500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcctttcttctgtactgt

SEQ ID NO: 85501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttttcctttcttctgtac

SEQ ID NO: 85502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttttcctttcttctgta

SEQ ID NO: 85503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctttttcctttcttctg

SEQ ID NO: 85504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcttcctttttcctttctt

SEQ ID NO: 85505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaataataaagaaatga

SEQ ID NO: 85506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaaaaagcaattaagaaa

SEQ ID NO: 85507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttagtaaaaaagcaattaag

SEQ ID NO: 85508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacacaggctgttagtaaa

SEQ ID NO: 85509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagacacaggctgttagtaa

SEQ ID NO: 85510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgagacacaggctgttag

SEQ ID NO: 85511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttgagacacaggctgtta

SEQ ID NO: 85512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttccttgagacacaggct

SEQ ID NO: 85513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcttccttgagacacaggc

SEQ ID NO: 85514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgaaatgaatatggcttgg

SEQ ID NO: 85515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatgaaatgaatatggct

SEQ ID NO: 85516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttattgatgaaatgaat

SEQ ID NO: 85517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgaaatgacagattaatg

SEQ ID NO: 85518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaatgaaatgacagatta

SEQ ID NO: 85519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgaatgaaatgacagatt

SEQ ID NO: 85520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttcctgaatgaaatgac

SEQ ID NO: 85521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatttcctgaatgaaatga

SEQ ID NO: 85522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtatttcctgaatgaaat

SEQ ID NO: 85523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtatttcctgaatgaaa

SEQ ID NO: 85524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttgtatttcctgaatgaa

SEQ ID NO: 85525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaccgaaacctttcttgta

SEQ ID NO: 85526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggttaaaaccgaaaccttt

SEQ ID NO: 85527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggttaaaaccgaaacctt

SEQ ID NO: 85528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaggttaaaaccgaaacc

SEQ ID NO: 85529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtattcttaaggttaaaacc

SEQ ID NO: 85530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaacaatataagagagat

SEQ ID NO: 85531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaaacaatataagagaga

SEQ ID NO: 85532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagtatgcttacaaaacaa

SEQ ID NO: 85533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaagtatgcttacaaaac

SEQ ID NO: 85534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgcaagtatgcttacaa

SEQ ID NO: 85535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acattattctgcaagtatgc

SEQ ID NO: 85536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtattgacattattctgca

SEQ ID NO: 85537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctatgtattgacattattc

SEQ ID NO: 85538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaccctccctatgtattga

SEQ ID NO: 85539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgccacacatgcagaaacac

SEQ ID NO: 85540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgccacacatgcagaaaca

SEQ ID NO: 85541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaacatttatgccacaca

SEQ ID NO: 85542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacaaacatttatgccacac

SEQ ID NO: 85543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacaaacatttatgccaca

SEQ ID NO: 85544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgacaaacatttatgcc

SEQ ID NO: 85545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattttgacaaacatttat

SEQ ID NO: 85546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaacaacatagtatacata

SEQ ID NO: 85547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaacaacatagtatacat

SEQ ID NO: 85548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatataaggtataatataa

SEQ ID NO: 85549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaatataaggtataatat

SEQ ID NO: 85550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaatataaggtataata

SEQ ID NO: 85551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagggcatcataatttctca

SEQ ID NO: 85552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagggcatcataatttctc

SEQ ID NO: 85553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatagggcatcataattt

SEQ ID NO: 85554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatttatagggcatcataat

SEQ ID NO: 85555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctatttatagggcatcata

SEQ ID NO: 85556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctatttatagggcatcat

SEQ ID NO: 85557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctatttatagggcatca

SEQ ID NO: 85558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctctatttatagggcatc

SEQ ID NO: 85559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcgcttttctctatttata

SEQ ID NO: 85560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgcgcttttctctatttat

SEQ ID NO: 85561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtgtttgtgcgcttttct

SEQ ID NO: 85562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacatacgtgctgatgtgtt

SEQ ID NO: 85563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagtctatacatacgtgc

SEQ ID NO: 85564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtattatatagtctatacat

SEQ ID NO: 85565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagtattatatagtctata

SEQ ID NO: 85566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtaaatgcaatatattat

SEQ ID NO: 85567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtaaatgcaatatatta

SEQ ID NO: 85568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagtaaatgcaatatatt

SEQ ID NO: 85569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacgattttaaagtaaatgc

SEQ ID NO: 85570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaacgattttaaagtaaat

SEQ ID NO: 85571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagcccaaagattctaaa

SEQ ID NO: 85572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatagcccaaagattctaa

SEQ ID NO: 85573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatagcccaaagattcta

SEQ ID NO: 85574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacaaactttaaatagccca

SEQ ID NO: 85575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacaaactttaaatagccc

SEQ ID NO: 85576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtacaaactttaaatagcc

SEQ ID NO: 85577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtacaaactttaaatagc

SEQ ID NO: 85578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtacaaactttaaatag

SEQ ID NO: 85579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttttttgtacaaacttta

SEQ ID NO: 85580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgttttttgtacaaacttt

SEQ ID NO: 85581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtcatttgtgttttttgt

SEQ ID NO: 85582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgaagtcatttgtgtttt

SEQ ID NO: 85583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgattgaagtcatttgtgt

SEQ ID NO: 85584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactgattgaagtcatttg

SEQ ID NO: 85585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattactgattgaagtcatt

SEQ ID NO: 85586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttctattactgattgaagt

SEQ ID NO: 85587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattggttctattactgatt

SEQ ID NO: 85588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actagattggttctattact

SEQ ID NO: 85589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgactagattggttctat

SEQ ID NO: 85590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catatggcattcattgacta

SEQ ID NO: 85591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtgtcaaaaagtgaccaa

SEQ ID NO: 85592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctgcagtgtcaaaaagtg

SEQ ID NO: 85593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggggtcatgactggcctg

SEQ ID NO: 85594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcacattgaaggggtcatga

SEQ ID NO: 85595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accattggcacattgaaggg

SEQ ID NO: 85596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtagttgaccattggcac

SEQ ID NO: 85597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgcagtagttgaccattg

SEQ ID NO: 85598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggaaaggcaggaaagctaa

SEQ ID NO: 85599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaggaaaggcaggaaagcta

SEQ ID NO: 85600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaccttaaggaaaggcagg

SEQ ID NO: 85601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagatattatcaccttaagg

SEQ ID NO: 85602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcctatagatattatcacc

SEQ ID NO: 85603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtcctatagatattatcac

SEQ ID NO: 85604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaggatggaaaacttggtc

SEQ ID NO: 85605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attataaggatggaaaactt

SEQ ID NO: 85606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattataaggatggaaaact

SEQ ID NO: 85607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taacacttaattataaggat

SEQ ID NO: 85608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaacacttaattataagga

SEQ ID NO: 85609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagccataatgtttgtaaca

SEQ ID NO: 85610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taattaaagccataatgttt

SEQ ID NO: 85611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agccacactataattaaagc

SEQ ID NO: 85612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagccacactataattaaag

SEQ ID NO: 85613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaacagtttaagccacac

SEQ ID NO: 85614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaacagtttaagccaca

SEQ ID NO: 85615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaaacagtttaagccac

SEQ ID NO: 85616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctttaaaaaacagtttaa

SEQ ID NO: 85617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatctttaaaaaacagttta

SEQ ID NO: 85618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggtttaatctttaaaaaa

SEQ ID NO: 85619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatggtttaatctttaaaa

SEQ ID NO: 85620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actctaatggtttaatcttt

SEQ ID NO: 85621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgactctaatggtttaatct

SEQ ID NO: 85622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgactctaatggtttaat

SEQ ID NO: 85623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgactctaatggtttaa

SEQ ID NO: 85624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctgactctaatggttta

SEQ ID NO: 85625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacgtgaggtagaaaatttt

SEQ ID NO: 85626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaacgtgaggtagaaaatt

SEQ ID NO: 85627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctaaacgtgaggtagaaa

SEQ ID NO: 85628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattctaaacgtgaggtaga

SEQ ID NO: 85629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagactctattctaaacgtg

SEQ ID NO: 85630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaagggtgatgatcaaaaa

SEQ ID NO: 85631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctggtaagggtgatgatc

SEQ ID NO: 85632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgagctggtaagggtgatg

SEQ ID NO: 85633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttattgagctggtaagggtg

SEQ ID NO: 85634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattattgagctggtaagg

SEQ ID NO: 85635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattgctattattgagctg

SEQ ID NO: 85636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggtattgctattattgag

SEQ ID NO: 85637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattggtattgctattatt

SEQ ID NO: 85638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattggtattgctatt

SEQ ID NO: 85639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attattattggtattgctat

SEQ ID NO: 85640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattattattggtattgcta

SEQ ID NO: 85641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattattattggtattgct

SEQ ID NO: 85642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggagatcttttattattatt

SEQ ID NO: 85643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgggagatcttttattatt

SEQ ID NO: 85644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgggagatcttttattat

SEQ ID NO: 85645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttattgggagatctttta

SEQ ID NO: 85646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaagcatataaattcattt

SEQ ID NO: 85647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcaagcatataaattcatt

SEQ ID NO: 85648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatttagcaagcatataaa

SEQ ID NO: 85649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatttagcaagcatataa

SEQ ID NO: 85650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttataatttagcaagcata

SEQ ID NO: 85651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgtgtagattgtttataa

SEQ ID NO: 85652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactgcatgtgtagattgtt

SEQ ID NO: 85653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acactgcatgtgtagattgt

SEQ ID NO: 85654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacactgcatgtgtagattg

SEQ ID NO: 85655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgcatatgttttacactg

SEQ ID NO: 85656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgcatatgttttacact

SEQ ID NO: 85657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgcatatgttttacac

SEQ ID NO: 85658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatgcatatgttttaca

SEQ ID NO: 85659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtatatttttaaatgcata

SEQ ID NO: 85660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtatatttttaaatgcat

SEQ ID NO: 85661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtatatttttaaatgca

SEQ ID NO: 85662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttgtgtatatttttaa

SEQ ID NO: 85663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttgtgtatattttta

SEQ ID NO: 85664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaataatgataaaataaa

SEQ ID NO: 85665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaataatgataaaataa

SEQ ID NO: 85666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagatcaaggtaatgataga

SEQ ID NO: 85667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaagatcaaggtaatgat

SEQ ID NO: 85668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaagatcaaggtaatga

SEQ ID NO: 85669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcaagatcaaggtaatg

SEQ ID NO: 85670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttattcaagatcaagg

SEQ ID NO: 85671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttattcaagatcaag

SEQ ID NO: 85672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtttcaattttattcaa

SEQ ID NO: 85673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagtttcaattttattca

SEQ ID NO: 85674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaagtttcaattttattc

SEQ ID NO: 85675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttaaaagtttcaatttt

SEQ ID NO: 85676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctttaaaagtttcaattt

SEQ ID NO: 85677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatctttaaaagtttcaat

SEQ ID NO: 85678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcttatctttaaaagttt

SEQ ID NO: 85679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattcttatctttaaaagtt

SEQ ID NO: 85680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttcattcttatctttaaa

SEQ ID NO: 85681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttcattcttatctttaa

SEQ ID NO: 85682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcttcattcttatcttta

SEQ ID NO: 85683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagagctttgtcttcattc

SEQ ID NO: 85684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaacaatgctggaagagct

SEQ ID NO: 85685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatgcacacctaagaaca

SEQ ID NO: 85686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagttgaatatgcacacc

SEQ ID NO: 85687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaagttgaatatgcacac

SEQ ID NO: 85688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtttccaaagttgaatat

SEQ ID NO: 85689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggtggatgtatgcaaagg

SEQ ID NO: 85690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtggtggatgtatgcaaag

SEQ ID NO: 85691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggtggtggatgtatgcaaa

SEQ ID NO: 85692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagggaagctttggtggtgg

SEQ ID NO: 85693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagggaagctttggtggt

SEQ ID NO: 85694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttctccagggaagctttg

SEQ ID NO: 85695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgagttctccagggaagc

SEQ ID NO: 85696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctgagttctccagggaag

SEQ ID NO: 85697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagcatgaaggtagggatgg

SEQ ID NO: 85698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagcatgaaggtagggatg

SEQ ID NO: 85699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcagcatgaaggtagggat

SEQ ID NO: 85700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcagcatgaaggtaggga

SEQ ID NO: 85701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaacgtttttgcagcatga

SEQ ID NO: 85702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgctaaaaacgtttttgc

SEQ ID NO: 85703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgtgctaaaaacgttttt

SEQ ID NO: 85704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatgcactctatgtgctaaa

SEQ ID NO: 85705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaactcaatgcactctatgt

SEQ ID NO: 85706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaactcaatgcactctatg

SEQ ID NO: 85707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaactcaatgcactctat

SEQ ID NO: 85708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttaaaactcaatgcact

SEQ ID NO: 85709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagaatgctagttttaaaa

SEQ ID NO: 85710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgttgaaagaatgctagtt

SEQ ID NO: 85711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctgatgttgaaagaatgc

SEQ ID NO: 85712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaatctgatgttgaaag

SEQ ID NO: 85713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattaatctgatgttgaaa

SEQ ID NO: 85714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcaagagaagacatttcaa

SEQ ID NO: 85715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaagatgttatgcaagaga

SEQ ID NO: 85716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagaaagatgttatgcaaga

SEQ ID NO: 85717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggctctagaaagatgtta

SEQ ID NO: 85718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaggctctagaaagatgtt

SEQ ID NO: 85719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaggctctagaaagatgt

SEQ ID NO: 85720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttacaggctctagaaag

SEQ ID NO: 85721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaattttacaggctctag

SEQ ID NO: 85722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttaattttacaggctcta

SEQ ID NO: 85723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttagttaattttacaggct

SEQ ID NO: 85724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cattatttagttaattttac

SEQ ID NO: 85725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactacattatttagttaat

SEQ ID NO: 85726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgcactacattatttagt

SEQ ID NO: 85727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgcactacattatttag

SEQ ID NO: 85728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacctgcactacattattta

SEQ ID NO: 85729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacctgcactacattattt

SEQ ID NO: 85730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttacctgcactacattatt

SEQ ID NO: 85731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgaataagactttttac

SEQ ID NO: 85732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatgaataagacttttta

SEQ ID NO: 85733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcatatgaataagacttt

SEQ ID NO: 85734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtaattatttcatatgaa

SEQ ID NO: 85735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accaagaaaattagtgtaat

SEQ ID NO: 85736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctcaccaagaaaattagt

SEQ ID NO: 85737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctcaccaagaaaattag

SEQ ID NO: 85738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctcaccaagaaaatta

SEQ ID NO: 85739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcacctcaccaagaaaatt

SEQ ID NO: 85740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcacctcaccaagaaaat

SEQ ID NO: 85741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcacctcaccaagaaaa

SEQ ID NO: 85742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttcacctcaccaagaa

SEQ ID NO: 85743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaacaagcaaagtatatg

SEQ ID NO: 85744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctataaaacaagcaaagtat

SEQ ID NO: 85745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctataaaacaagcaaagta

SEQ ID NO: 85746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcctataaaacaagcaaagt

SEQ ID NO: 85747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcctataaaacaagcaaag

SEQ ID NO: 85748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcctataaaacaagcaaa

SEQ ID NO: 85749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcctataaaacaagcaa

SEQ ID NO: 85750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taatttttttcctataaaac

SEQ ID NO: 85751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacaaatctataatttttt

SEQ ID NO: 85752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataggttatcacaaatcta

SEQ ID NO: 85753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaataggttatcacaaatc

SEQ ID NO: 85754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaattctaaataggttatca

SEQ ID NO: 85755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attagaattctaaataggtt

SEQ ID NO: 85756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataaaacattgattagaa

SEQ ID NO: 85757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaataaaacattgattaga

SEQ ID NO: 85758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaataaaacattgattag

SEQ ID NO: 85759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaataaaacattgatta

SEQ ID NO: 85760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgaaataaaacattgatt

SEQ ID NO: 85761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgaaataaaacattga

SEQ ID NO: 85762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttgaaataaaacattg

SEQ ID NO: 85763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttgaaataaaacatt

SEQ ID NO: 85764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttctttttgaaataaaac

SEQ ID NO: 85765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttctttttgaaataaa

SEQ ID NO: 85766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgttttctttttgaaataa

SEQ ID NO: 85767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttctgttttctttttgaaa

SEQ ID NO: 85768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttctgttttctttttgaa

SEQ ID NO: 85769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacttctgttttctttttga

SEQ ID NO: 85770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgtgaagcctttacttct

SEQ ID NO: 85771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgtgaagcctttacttc

SEQ ID NO: 85772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgtgaagcctttactt

SEQ ID NO: 85773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatatgtgaagcctttact

SEQ ID NO: 85774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtttttatatgtgaagcct

SEQ ID NO: 85775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtttttatatgtgaagcc

SEQ ID NO: 85776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggtttttatatgtgaagc

SEQ ID NO: 85777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagctttgggtttttatat

SEQ ID NO: 85778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaaaagctttgggttttta

SEQ ID NO: 85779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaatatcaacatatgtaa

SEQ ID NO: 85780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tataaaatatcaacatatgt

SEQ ID NO: 85781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttctataaaatatcaacat

SEQ ID NO: 85782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagttctataaaatatcaa

SEQ ID NO: 85783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatacaagcattcctagt

SEQ ID NO: 85784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaatacaagcattcctag

SEQ ID NO: 85785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaatacaagcattccta

SEQ ID NO: 85786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttgaaaatacaagcattc

SEQ ID NO: 85787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattttgaaaatacaagcat

SEQ ID NO: 85788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctattttgaaaatacaagca

SEQ ID NO: 85789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatcaatcaaaaacttctat

SEQ ID NO: 85790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatcaatcaaaaacttcta

SEQ ID NO: 85791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatcaatcaaaaacttct

SEQ ID NO: 85792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtattttgtatcaatcaaaa

SEQ ID NO: 85793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagaaaagtaatctagtat

SEQ ID NO: 85794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagaaaagtaatctagta

SEQ ID NO: 85795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccagaaaagtaatctagt

SEQ ID NO: 85796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccagaaaagtaatctag

SEQ ID NO: 85797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcccagaaaagtaatcta

SEQ ID NO: 85798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttcccagaaaagtaatc

SEQ ID NO: 85799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttcccagaaaagtaat

SEQ ID NO: 85800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttcccagaaaagtaa

SEQ ID NO: 85801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttttcccagaaaagta

SEQ ID NO: 85802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttttcccagaaaagt

SEQ ID NO: 85803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctttttcccagaaaag

SEQ ID NO: 85804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttttctttttcccaga

SEQ ID NO: 85805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttttttctttttcccag

SEQ ID NO: 85806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatttttttctttttcc

SEQ ID NO: 85807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaatttttttctttttc

SEQ ID NO: 85808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttaatttttttcttttt

SEQ ID NO: 85809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataaaataaatattttat

SEQ ID NO: 85810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaataaaataaatatttta

SEQ ID NO: 85811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgaaataaaataaatattt

SEQ ID NO: 85812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatgatgtatagaatcact

SEQ ID NO: 85813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatgatgtatagaatcac

SEQ ID NO: 85814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagatgatgtatagaatca

SEQ ID NO: 85815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttgagatgatgtataga

SEQ ID NO: 85816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactttgagatgatgtatag

SEQ ID NO: 85817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgactttgagatgatgta

SEQ ID NO: 85818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttgactttgagatgatgt

SEQ ID NO: 85819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgcttgactttgagatgat

SEQ ID NO: 85820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcttgcttgactttgaga

SEQ ID NO: 85821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaccaaaggttccctcttg

SEQ ID NO: 85822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtcctcaaaccaaaggtt

SEQ ID NO: 85823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataccatcctatagtcctca

SEQ ID NO: 85824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataccatcctatagtcctc

SEQ ID NO: 85825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaataccatcctatagtcc

SEQ ID NO: 85826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagttcttaataccatcct

SEQ ID NO: 85827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatagttcttaataccatc

SEQ ID NO: 85828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatagttcttaataccat

SEQ ID NO: 85829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcatagttcttaatacca

SEQ ID NO: 85830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctcatagttcttaatac

SEQ ID NO: 85831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatcaggttctttctcata

SEQ ID NO: 85832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caattcaaatcaggttcttt

SEQ ID NO: 85833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacatgcaacaagaaaaaa

SEQ ID NO: 85834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaagtaaagacatgttat

SEQ ID NO: 85835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagaagtaaagacatgtta

SEQ ID NO: 85836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgaggaaaccgtggttta

SEQ ID NO: 85837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgaggaaaccgtggttt

SEQ ID NO: 85838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgaggaaaccgtggtt

SEQ ID NO: 85839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaatgaggaaaccgtggt

SEQ ID NO: 85840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcaatgaggaaaccgtgg

SEQ ID NO: 85841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactttttcaatgaggaaac

SEQ ID NO: 85842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccactttttcaatgaggaaa

SEQ ID NO: 85843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccttccactttttcaatga

SEQ ID NO: 85844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggcatgagccatcacacc

SEQ ID NO: 85845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattataggcatgagccat

SEQ ID NO: 85846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctgggattatag

SEQ ID NO: 85847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggcctcccaaagtgctggga

SEQ ID NO: 85848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccctcggcctcccaaagtgc

SEQ ID NO: 85849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatccactcccctcggcct

SEQ ID NO: 85850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtagctgagatccactccc

SEQ ID NO: 85851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtagctgagatccactcc

SEQ ID NO: 85852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgagtagctgagatccact

SEQ ID NO: 85853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcttgagtagctgaga

SEQ ID NO: 85854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcagcctcttgagtagct

SEQ ID NO: 85855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagcaaacatcctgtctcag

SEQ ID NO: 85856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catccccaggggctcaagca

SEQ ID NO: 85857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacctccatccccaggggc

SEQ ID NO: 85858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgcaacctccatccccag

SEQ ID NO: 85859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtgcagtggcacagtcaca

SEQ ID NO: 85860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggctgagtgcagtggca

SEQ ID NO: 85861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcccaggctgagtgcagt

SEQ ID NO: 85862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctcccaggctgagtgca

SEQ ID NO: 85863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actctgtctcccaggctgag

SEQ ID NO: 85864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacacaatctcactctgtc

SEQ ID NO: 85865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaacacaatctcactctgt

SEQ ID NO: 85866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaacacaatctcactctg

SEQ ID NO: 85867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaacacaatctcactct

SEQ ID NO: 85868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaaacacaatctcactc

SEQ ID NO: 85869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgaaacacaatctcact

SEQ ID NO: 85870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttgaaacacaatctcac

SEQ ID NO: 85871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttgaaacacaatctc

SEQ ID NO: 85872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttttgaaacacaatct

SEQ ID NO: 85873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttttgaaacacaatc

SEQ ID NO: 85874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctttttttgaaacacaat

SEQ ID NO: 85875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttctttttttgaaacaca

SEQ ID NO: 85876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttctttttttgaaacac

SEQ ID NO: 85877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttctttttttgaaaca

SEQ ID NO: 85878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttttctttttttgaaac

SEQ ID NO: 85879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcttttctttttttgaa

SEQ ID NO: 85880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttcttttctttttttga

SEQ ID NO: 85881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttcttttctttttttg

SEQ ID NO: 85882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttttcttttcttttttt

SEQ ID NO: 85883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcttttcttttcttttt

SEQ ID NO: 85884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttcttttcttttctttt

SEQ ID NO: 85885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttcttttcttttcttt

SEQ ID NO: 85886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttttcttttcttttctt

SEQ ID NO: 85887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcttttcttttcttttc

SEQ ID NO: 85888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttcttttcttttctttt

SEQ ID NO: 85889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttcttttcttttcttt

SEQ ID NO: 85890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttttcttttcttttctt

SEQ ID NO: 85891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcttttcttttcttttct

SEQ ID NO: 85892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cactttttcttttcttttct

SEQ ID NO: 85893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctccactttttcttttctt

SEQ ID NO: 85894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatctccactttttctttt

SEQ ID NO: 85895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgcacacaataatataa

SEQ ID NO: 85896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtaatgcacacaataata

SEQ ID NO: 85897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctattgtaatgcacacaat

SEQ ID NO: 85898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacattatctattgtaatgc

SEQ ID NO: 85899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtacattatctattgtaatg

SEQ ID NO: 85900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cataaaatgatttgtacatt

SEQ ID NO: 85901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagcatctacataaaatg

SEQ ID NO: 85902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattataaagcatctacata

SEQ ID NO: 85903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattataaagcatctacat

SEQ ID NO: 85904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacattataaagcatctaca

SEQ ID NO: 85905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actttacattataaagcatc

SEQ ID NO: 85906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcactttacattataaagc

SEQ ID NO: 85907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactcactttacattataaa

SEQ ID NO: 85908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccctctactcactttacat

SEQ ID NO: 85909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccctctactcactttaca

SEQ ID NO: 85910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcccctctactcactttac

SEQ ID NO: 85911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctttgcccctctactcac

SEQ ID NO: 85912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgctttgcccctctactca

SEQ ID NO: 85913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtgctttgcccctctact

SEQ ID NO: 85914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtggttcttgtgctttgcc

SEQ ID NO: 85915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatgtattgagtggttctt

SEQ ID NO: 85916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatatgtattgagtggttct

SEQ ID NO: 85917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatttaatatgtattgagt

SEQ ID NO: 85918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatttaatatgtattgag

SEQ ID NO: 85919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagatttaatatgtattga

SEQ ID NO: 85920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcattttgagatttaatatg

SEQ ID NO: 85921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcattttgagatttaatat

SEQ ID NO: 85922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acacttagcattttgagatt

SEQ ID NO: 85923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaagtaaagaattgacact

SEQ ID NO: 85924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctcacaagtaaagaattga

SEQ ID NO: 85925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatctcacaagtaaagaat

SEQ ID NO: 85926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atctgttatctcacaagtaa

SEQ ID NO: 85927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgatcctaatctgttatc

SEQ ID NO: 85928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatgatcctaatctgtta

SEQ ID NO: 85929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataattctccatgatccta

SEQ ID NO: 85930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agataattctccatgatcct

SEQ ID NO: 85931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagataattctccatgatcc

SEQ ID NO: 85932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagataattctccatgatc

SEQ ID NO: 85933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catagaaaggcatatgtact

SEQ ID NO: 85934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatagaaaggcatatgta

SEQ ID NO: 85935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccatagaaaggcatatgt

SEQ ID NO: 85936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatttctccatagaaaggc

SEQ ID NO: 85937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcatttctccatagaaagg

SEQ ID NO: 85938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaaagacttagcatttct

SEQ ID NO: 85939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtaaaaagacttagcatt

SEQ ID NO: 85940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattcctgtaaaaagactta

SEQ ID NO: 85941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggattcctgtaaaaagactt

SEQ ID NO: 85942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagcaaagtttggattcctg

SEQ ID NO: 85943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taactaaagcaaagtttgga

SEQ ID NO: 85944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaactaaagcaaagttt

SEQ ID NO: 85945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatatgatgttactgtaac

SEQ ID NO: 85946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attggaatatgatgttactg

SEQ ID NO: 85947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgattggaatatgatgtt

SEQ ID NO: 85948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgattggaatatgatgt

SEQ ID NO: 85949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttagttgattggaatatg

SEQ ID NO: 85950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtttagttgattggaatat

SEQ ID NO: 85951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttagtttagttgattgga

SEQ ID NO: 85952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctagtttagtttagttga

SEQ ID NO: 85953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgtgctagtttagtttag

SEQ ID NO: 85954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctgtgctagtttagttta

SEQ ID NO: 85955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtctgtgctagtttagttt

SEQ ID NO: 85956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtctgtgctagtttagtt

SEQ ID NO: 85957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtctgtgctagtttagt

SEQ ID NO: 85958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgtctgtgctagttta

SEQ ID NO: 85959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttgtctgtgctagttt

SEQ ID NO: 85960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttgtctgtgctagtt

SEQ ID NO: 85961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctttttgtctgtgctagt

SEQ ID NO: 85962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtacttttctttttgtctg

SEQ ID NO: 85963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaagtacttttcttttt

SEQ ID NO: 85964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattaagtacttttctttt

SEQ ID NO: 85965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaattaagtacttttcttt

SEQ ID NO: 85966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaattaagtacttttctt

SEQ ID NO: 85967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaatgtgatgtgatcaat

SEQ ID NO: 85968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagtaatgtgatgtgatca

SEQ ID NO: 85969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctaagtaatgtgatgtga

SEQ ID NO: 85970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctaagtaatgtgatgtg

SEQ ID NO: 85971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttattctaagtaatgtga

SEQ ID NO: 85972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catttattctaagtaatgtg

SEQ ID NO: 85973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttcatttattctaagta

SEQ ID NO: 85974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacttcatttattctaagt

SEQ ID NO: 85975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accttatacttcatttattc

SEQ ID NO: 85976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccttatacttcatttatt

SEQ ID NO: 85977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccttatacttcatttat

SEQ ID NO: 85978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaccttatacttcattta

SEQ ID NO: 85979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatacttttaaccttatac

SEQ ID NO: 85980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatacttttaaccttata

SEQ ID NO: 85981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatatacttttaaccttat

SEQ ID NO: 85982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtcatattttgatatact

SEQ ID NO: 85983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatgtcatattttgatat

SEQ ID NO: 85984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtattattaatgtcatattt

SEQ ID NO: 85985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtattattaatgtcatatt

SEQ ID NO: 85986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtattattaatgtcatat

SEQ ID NO: 85987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtattattaatgtcata

SEQ ID NO: 85988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagtattattaatgtcat

SEQ ID NO: 85989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaggctttttagtattatt

SEQ ID NO: 85990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaggctttttagtattat

SEQ ID NO: 85991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataaggctttttagtatta

SEQ ID NO: 85992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actttataaggctttttagt

SEQ ID NO: 85993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactttataaggctttttag

SEQ ID NO: 85994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactttataaggcttttta

SEQ ID NO: 85995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaactttataaggcttttt

SEQ ID NO: 85996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatatttttaactttataa

SEQ ID NO: 85997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatatttttaactttata

SEQ ID NO: 85998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatatatttttaactttat

SEQ ID NO: 85999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtcatattttgatatatt

SEQ ID NO: 86000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaatgtcatattttgatat

SEQ ID NO: 86001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattaatgtcatattttga

SEQ ID NO: 86002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attattaatgtcatattttg

SEQ ID NO: 86003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgaaataatagataata

SEQ ID NO: 86004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaatgaaataatagataat

SEQ ID NO: 86005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagcttcaaatgaaataat

SEQ ID NO: 86006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatcagcttcaaatgaaat

SEQ ID NO: 86007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagtgctattatcagcttc

SEQ ID NO: 86008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagtgctattatcagctt

SEQ ID NO: 86009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagtgctattatcagct

SEQ ID NO: 86010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagtgctattatcagc

SEQ ID NO: 86011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagtagtgctattatcag

SEQ ID NO: 86012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttagtagtgctattatca

SEQ ID NO: 86013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggtatcttttttagtagt

SEQ ID NO: 86014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggtgatagttaatggta

SEQ ID NO: 86015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actcccaggtgatagttaat

SEQ ID NO: 86016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttgactcccaggtgata

SEQ ID NO: 86017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattcatgttgactcccag

SEQ ID NO: 86018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catattcatgttgactccca

SEQ ID NO: 86019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atatttcatattcatgttga

SEQ ID NO: 86020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatatttcatattcatgtt

SEQ ID NO: 86021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatatttcatattcatgt

SEQ ID NO: 86022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggtttctcatatttcatat

SEQ ID NO: 86023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggtttctcatatttcata

SEQ ID NO: 86024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtggtttctcatatttcat

SEQ ID NO: 86025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgtggtttctcatatttc

SEQ ID NO: 86026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttgtggtttctcatattt

SEQ ID NO: 86027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttgtggtttctcatatt

SEQ ID NO: 86028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctttgtggtttctcatat

SEQ ID NO: 86029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaaaggcttttctttgtg

SEQ ID NO: 86030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcaaaggcttttctttgt

SEQ ID NO: 86031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcatcaaaggcttttctt

SEQ ID NO: 86032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtaagatgctgtttcatcaa

SEQ ID NO: 86033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtaagatgctgtttcatca

SEQ ID NO: 86034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttcgtaagatgctgtttc

SEQ ID NO: 86035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttcgtaagatgctgttt

SEQ ID NO: 86036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtccttagtttcgtaag

SEQ ID NO: 86037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcgaatgtacaaattacaa

SEQ ID NO: 86038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagcgaatgtacaaattac

SEQ ID NO: 86039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagcgaatgtacaaatta

SEQ ID NO: 86040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaagcgaatgtacaaatt

SEQ ID NO: 86041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttctaagcgaatgtacaa

SEQ ID NO: 86042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggactattttctaagcga

SEQ ID NO: 86043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaggactattttctaagcg

SEQ ID NO: 86044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggcggatgacttgaagga

SEQ ID NO: 86045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatggcggatgacttgaag

SEQ ID NO: 86046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaattctaatggcggatg

SEQ ID NO: 86047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaggttaaacaattctaat

SEQ ID NO: 86048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaaggttaaacaattctaa

SEQ ID NO: 86049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgcaaggttaaacaattct

SEQ ID NO: 86050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accaagcccagtactcttgc

SEQ ID NO: 86051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaccaagcccagtactcttg

SEQ ID NO: 86052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaccaagcccagtactctt

SEQ ID NO: 86053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaccaagcccagtactct

SEQ ID NO: 86054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgaccaagcccagtact

SEQ ID NO: 86055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgaccaagcccagtac

SEQ ID NO: 86056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtttcttttgaccaagccc

SEQ ID NO: 86057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagagctgagtttcttttga

SEQ ID NO: 86058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagagctgagtttcttttg

SEQ ID NO: 86059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtataatgatgatttataga

SEQ ID NO: 86060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctagtataatgatgatttat

SEQ ID NO: 86061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgaattgctagtataatga

SEQ ID NO: 86062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatgctgatgaattgctag

SEQ ID NO: 86063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacaagatctaacatgctga

SEQ ID NO: 86064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acacaagatctaacatgctg

SEQ ID NO: 86065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacacaagatctaacatgct

SEQ ID NO: 86066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttacacaagatctaacatgc

SEQ ID NO: 86067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgccttttacacaagatcta

SEQ ID NO: 86068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtgccttttacacaaga

SEQ ID NO: 86069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattgtgccttttacacaag

SEQ ID NO: 86070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggggagaaaaatcatagca

SEQ ID NO: 86071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtggggagaaaaatcata

SEQ ID NO: 86072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtggggagaaaaatcat

SEQ ID NO: 86073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgttgtggggagaaaaat

SEQ ID NO: 86074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattatttgttgtggggaga

SEQ ID NO: 86075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaacaaattagattatttg

SEQ ID NO: 86076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaacaaattagattattt

SEQ ID NO: 86077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaggagcttcaaaacaaat

SEQ ID NO: 86078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaaaagagacatgaaaag

SEQ ID NO: 86079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagaaaagagacatgaaaa

SEQ ID NO: 86080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccagaaaagagacatgaaa

SEQ ID NO: 86081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggtggctttccagaaaag

SEQ ID NO: 86082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacaaaggattgtaggtggc

SEQ ID NO: 86083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacaaaggattgtaggtgg

SEQ ID NO: 86084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttgcacaaaggattgtagg

SEQ ID NO: 86085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgtttgcacaaaggattg

SEQ ID NO: 86086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctgtttgcacaaaggatt

SEQ ID NO: 86087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctgtttgcacaaaggat

SEQ ID NO: 86088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttccctgtttgcacaaagg

SEQ ID NO: 86089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttccctgtttgcacaaag

SEQ ID NO: 86090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttccctgtttgcacaaa

SEQ ID NO: 86091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttccctgtttgcacaa

SEQ ID NO: 86092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttccctgtttgcaca

SEQ ID NO: 86093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttttctttccctgtttgc

SEQ ID NO: 86094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgttttttctttccctgt

SEQ ID NO: 86095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattgttttttctttccctg

SEQ ID NO: 86096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtatcttgattgttttttct

SEQ ID NO: 86097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtatcttgattgttttttc

SEQ ID NO: 86098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttggtatcttgattgttt

SEQ ID NO: 86099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttggtatcttgattgtt

SEQ ID NO: 86100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagtttggtatcttgattg

SEQ ID NO: 86101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacctcttagtttggtatct

SEQ ID NO: 86102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacctcttagtttggtatc

SEQ ID NO: 86103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatgtcagtgatggaaatt

SEQ ID NO: 86104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcatacagctatgatgtca

SEQ ID NO: 86105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atctaatcatacagctatga

SEQ ID NO: 86106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatctaatcatacagctat

SEQ ID NO: 86107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatctaatcatacagcta

SEQ ID NO: 86108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcatctaatcatacagct

SEQ ID NO: 86109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttttctcatctaatcata

SEQ ID NO: 86110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttttctcatctaatcat

SEQ ID NO: 86111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggttttctcatctaatca

SEQ ID NO: 86112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacatattttgggttttct

SEQ ID NO: 86113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcccacatattttgggttt

SEQ ID NO: 86114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctcccacatattttgggt

SEQ ID NO: 86115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcctcccacatattttggg

SEQ ID NO: 86116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggccttctcctcccacat

SEQ ID NO: 86117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catggccttctcctcccaca

SEQ ID NO: 86118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttcatggccttctcctc

SEQ ID NO: 86119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtttcatggccttctcct

SEQ ID NO: 86120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtttcatggccttctcc

SEQ ID NO: 86121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatcaggggcagaggattt

SEQ ID NO: 86122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatcaggggcagaggatt

SEQ ID NO: 86123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttcacatcaggggcagagg

SEQ ID NO: 86124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgcttcacatcaggggcag

SEQ ID NO: 86125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactgctgcttcacatcagg

SEQ ID NO: 86126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acactgctgcttcacatcag

SEQ ID NO: 86127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttacactgctgcttcaca

SEQ ID NO: 86128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcttacactgctgcttca

SEQ ID NO: 86129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtcttacactgctgcttc

SEQ ID NO: 86130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgtcttacactgctgctt

SEQ ID NO: 86131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgctttctgtcttacac

SEQ ID NO: 86132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaaagataacaaaggacat

SEQ ID NO: 86133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggcaaagataacaaaggac

SEQ ID NO: 86134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggcaaagataacaaagga

SEQ ID NO: 86135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gagaaaaagcttctggcaaa

SEQ ID NO: 86136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcgagaaaaagcttctggc

SEQ ID NO: 86137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcctcgagaaaaagcttc

SEQ ID NO: 86138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttcctcgagaaaaagctt

SEQ ID NO: 86139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttagttcctcgagaaaa

SEQ ID NO: 86140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatttagttcctcgagaaa

SEQ ID NO: 86141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatgtagtcaaagcttcca

SEQ ID NO: 86142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaggtctgaaatgtagtc

SEQ ID NO: 86143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgaggtctgaaatgtagt

SEQ ID NO: 86144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatgaggtctgaaatgtag

SEQ ID NO: 86145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatgaggtctgaaatgt

SEQ ID NO: 86146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcatgaggtctgaaatg

SEQ ID NO: 86147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctttcatgaggtctgaa

SEQ ID NO: 86148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctttcatgaggtctga

SEQ ID NO: 86149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttatttctttcatgaggt

SEQ ID NO: 86150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatctaatttatttctttc

SEQ ID NO: 86151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaataaaatcagctcaaat

SEQ ID NO: 86152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggtatattcacaataaaat

SEQ ID NO: 86153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtaattggggtatattca

SEQ ID NO: 86154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggagtaattggggtatat

SEQ ID NO: 86155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcctggagtaattggggt

SEQ ID NO: 86156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactcctggagtaattgggg

SEQ ID NO: 86157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactcctggagtaattggg

SEQ ID NO: 86158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatattttaactcctggag

SEQ ID NO: 86159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacacaggctgtaatatttt

SEQ ID NO: 86160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atacacaggctgtaatattt

SEQ ID NO: 86161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatacccatcttatacacag

SEQ ID NO: 86162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagccactagatacccatct

SEQ ID NO: 86163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgaagccactagataccca

SEQ ID NO: 86164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactgaagccactagatacc

SEQ ID NO: 86165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagactctactgaagccact

SEQ ID NO: 86166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacatggatgatagttaaag

SEQ ID NO: 86167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccacatggatgatagttaaa

SEQ ID NO: 86168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccttccacatggatgatag

SEQ ID NO: 86169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctacccttccacatggatga

SEQ ID NO: 86170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctacccttccacatggatg

SEQ ID NO: 86171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctacccttccacatggat

SEQ ID NO: 86172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctacccttccacatgga

SEQ ID NO: 86173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgctacccttccacatgg

SEQ ID NO: 86174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgctacccttccacatg

SEQ ID NO: 86175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagcagtcatttttttgc

SEQ ID NO: 86176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agggcattatatagcagtca

SEQ ID NO: 86177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcagggcattatatagca

SEQ ID NO: 86178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcattcagggcattatat

SEQ ID NO: 86179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcattcattcagggcatt

SEQ ID NO: 86180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgattcattcattcaggg

SEQ ID NO: 86181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgattgattcattcattc

SEQ ID NO: 86182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcattgattgattcattc

SEQ ID NO: 86183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattcattgattgattcatt

SEQ ID NO: 86184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaccacataatcaagata

SEQ ID NO: 86185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaagaacattgagtacca

SEQ ID NO: 86186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgaaagaacattgagtac

SEQ ID NO: 86187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatagagattctgtgaaa

SEQ ID NO: 86188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaaatcctaaaaatagag

SEQ ID NO: 86189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgatgtcctgaagaaat

SEQ ID NO: 86190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcatgatgtcctgaagaaa

SEQ ID NO: 86191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcatgatgtcctgaagaa

SEQ ID NO: 86192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgtcatgatgtcctga

SEQ ID NO: 86193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtactaattttgtcatgat

SEQ ID NO: 86194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcacaccacaattcagtac

SEQ ID NO: 86195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttatgcacaccacaattc

SEQ ID NO: 86196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagttatgcacaccacaat

SEQ ID NO: 86197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagttatgcacaccacaa

SEQ ID NO: 86198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaagttatgcacaccaca

SEQ ID NO: 86199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaagttatgcacaccac

SEQ ID NO: 86200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctaagttatgcacacca

SEQ ID NO: 86201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctaagttatgcacacc

SEQ ID NO: 86202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcatatttttttctaagtt

SEQ ID NO: 86203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcatatttttttctaagt

SEQ ID NO: 86204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgcatatttttttctaag

SEQ ID NO: 86205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttatgcatatttttttct

SEQ ID NO: 86206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagcacagggtagctgcttt

SEQ ID NO: 86207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagcacagggtagctgctt

SEQ ID NO: 86208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttgtagcacagggtagc

SEQ ID NO: 86209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaaaaaattacatttgta

SEQ ID NO: 86210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatagaaaaaattacattt

SEQ ID NO: 86211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgttatagaaaaaattac

SEQ ID NO: 86212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattgttatagaaaaaatt

SEQ ID NO: 86213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgaggataataacatgt

SEQ ID NO: 86214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgaattaaaatgaggata

SEQ ID NO: 86215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccatgaattaaaatgagga

SEQ ID NO: 86216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taactctccatgaattaaaa

SEQ ID NO: 86217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatgaacatctgtaactct

SEQ ID NO: 86218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctcaaatgaacatctgtaa

SEQ ID NO: 86219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atctatctcaaatgaacatc

SEQ ID NO: 86220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgatctatctcaaatgaac

SEQ ID NO: 86221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccactcctgatctatctca

SEQ ID NO: 86222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcccactcctgatctatct

SEQ ID NO: 86223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctctgcccactcctgatct

SEQ ID NO: 86224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacctgcctctgcccactc

SEQ ID NO: 86225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaacctgcctctgcccact

SEQ ID NO: 86226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaagaggcggatataagct

SEQ ID NO: 86227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaagaggcggatataagc

SEQ ID NO: 86228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaagaggcggatataag

SEQ ID NO: 86229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacgtggtgaaagttttcaa

SEQ ID NO: 86230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcaacgtggtgaaagtt

SEQ ID NO: 86231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagagcatactgacctcaac

SEQ ID NO: 86232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagagcatactgacctcaa

SEQ ID NO: 86233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagagcatactgacctca

SEQ ID NO: 86234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaagagcatactgacctc

SEQ ID NO: 86235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaagagcatactgacct

SEQ ID NO: 86236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcaagagcatactgacc

SEQ ID NO: 86237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttcaagagcatactgac

SEQ ID NO: 86238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttttttcaagagcatact

SEQ ID NO: 86239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttactttttttcaagagcat

SEQ ID NO: 86240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttactttttttcaagagca

SEQ ID NO: 86241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttactttttttcaagagc

SEQ ID NO: 86242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttactttttttcaagag

SEQ ID NO: 86243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttactttttttcaaga

SEQ ID NO: 86244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgttactttttttcaag

SEQ ID NO: 86245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgttactttttttcaa

SEQ ID NO: 86246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttgttactttttttca

SEQ ID NO: 86247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttttttgttactttttt

SEQ ID NO: 86248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctacttttttttgttactt

SEQ ID NO: 86249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctacttttttttgttact

SEQ ID NO: 86250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctacttttttttgttac

SEQ ID NO: 86251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccctacttttttttgtta

SEQ ID NO: 86252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatcaatcaataaacccctt

SEQ ID NO: 86253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatcaatcaataaacccct

SEQ ID NO: 86254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatcaatcaataaacccc

SEQ ID NO: 86255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttttatatcaatcaataaa

SEQ ID NO: 86256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttttatatcaatcaataa

SEQ ID NO: 86257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacttagttttatatcaat

SEQ ID NO: 86258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaacttagttttatatca

SEQ ID NO: 86259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggaacttagttttatatc

SEQ ID NO: 86260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggaacttagttttatat

SEQ ID NO: 86261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctggaacttagttttata

SEQ ID NO: 86262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttctggaacttagtttt

SEQ ID NO: 86263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattgtttttctggaactta

SEQ ID NO: 86264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatgcctagattgtttttc

SEQ ID NO: 86265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatgcctagattgttttt

SEQ ID NO: 86266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgaaatgcctagattgt

SEQ ID NO: 86267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaatttgaaatgcctagat

SEQ ID NO: 86268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattaatttgaaatgcctag

SEQ ID NO: 86269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcctctattaatttgaaatg

SEQ ID NO: 86270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcctctattaatttgaaat

SEQ ID NO: 86271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcctctattaatttgaaa

SEQ ID NO: 86272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgtcctctattaatttg

SEQ ID NO: 86273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgtcctctattaattt

SEQ ID NO: 86274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgttttgtcctctattaa

SEQ ID NO: 86275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgttttgtcctctatta

SEQ ID NO: 86276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgtttgtttgttttgtcc

SEQ ID NO: 86277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatgtttgtttgttttgtc

SEQ ID NO: 86278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtatgtttgtttgtttt

SEQ ID NO: 86279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtatgtttgtttgttt

SEQ ID NO: 86280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttgtatgtttgtttgtt

SEQ ID NO: 86281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttgtatgtttgtttgt

SEQ ID NO: 86282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttgtttgtatgtttgtt

SEQ ID NO: 86283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatctgtttttgtttgtatg

SEQ ID NO: 86284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaattatatctgtttttgt

SEQ ID NO: 86285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggcaattatatctgttttt

SEQ ID NO: 86286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggcaattatatctgtttt

SEQ ID NO: 86287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggcaattatatctgttt

SEQ ID NO: 86288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacaggattttctggcaatt

SEQ ID NO: 86289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caacaggattttctggcaat

SEQ ID NO: 86290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcttcaacaggattttctg

SEQ ID NO: 86291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcttcaacaggattttct

SEQ ID NO: 86292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaagaaggaaagcaataa

SEQ ID NO: 86293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacatcaggagctcaggaa

SEQ ID NO: 86294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaacatcaggagctcagga

SEQ ID NO: 86295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgatgacaacttacaacat

SEQ ID NO: 86296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaatgatgacaacttacaa

SEQ ID NO: 86297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attactaatgatgacaactt

SEQ ID NO: 86298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattactaatgatgacaact

SEQ ID NO: 86299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggaggaggtagtagtagcg

SEQ ID NO: 86300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggaggaggtagtagtagc

SEQ ID NO: 86301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttggggaggaggtagtagt

SEQ ID NO: 86302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttggggaggaggtagtag

SEQ ID NO: 86303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttggggaggaggtagta

SEQ ID NO: 86304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatttggggaggaggta

SEQ ID NO: 86305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttatttggggaggaggt

SEQ ID NO: 86306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatgaaaataaaaagatat

SEQ ID NO: 86307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggatgaaaataaaaagata

SEQ ID NO: 86308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgggatgaaaataaaaaga

SEQ ID NO: 86309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttgggatgaaaataaaaa

SEQ ID NO: 86310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagatattctcttgggatg

SEQ ID NO: 86311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcgttagaagatattctctt

SEQ ID NO: 86312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcgttagaagatattctc

SEQ ID NO: 86313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatcgttagaagatattct

SEQ ID NO: 86314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatgataaacttctatcgt

SEQ ID NO: 86315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaacatgataaacttctat

SEQ ID NO: 86316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctaacatgataaacttcta

SEQ ID NO: 86317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctaacatgataaacttc

SEQ ID NO: 86318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcctaacatgataaactt

SEQ ID NO: 86319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttcctaacatgataaact

SEQ ID NO: 86320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcttcctaacatgataa

SEQ ID NO: 86321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacagttgctttcttcctaa

SEQ ID NO: 86322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacagttgctttcttccta

SEQ ID NO: 86323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagtgtaatgtgtaatgc

SEQ ID NO: 86324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaatattggaaagtgtaa

SEQ ID NO: 86325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtaatattggaaagtgta

SEQ ID NO: 86326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtaatattggaaagtgt

SEQ ID NO: 86327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcagtaatattggaaagtg

SEQ ID NO: 86328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttcagtaatattggaaa

SEQ ID NO: 86329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttgtttttcagtaatatt

SEQ ID NO: 86330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gattcagttgtttttcagta

SEQ ID NO: 86331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agggaggaagctagattcag

SEQ ID NO: 86332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaattcagggaggaagct

SEQ ID NO: 86333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgcagaatactcccaaatt

SEQ ID NO: 86334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgcagaatactcccaaat

SEQ ID NO: 86335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgcagaatactcccaaa

SEQ ID NO: 86336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagccattttagtgcagaa

SEQ ID NO: 86337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagccattttagtgcaga

SEQ ID NO: 86338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggcagatgacaaaattta

SEQ ID NO: 86339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaggcagatgacaaaattt

SEQ ID NO: 86340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcaaggcagatgacaaaa

SEQ ID NO: 86341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtttcaaggcagatgaca

SEQ ID NO: 86342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtttcaaggcagatgac

SEQ ID NO: 86343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttgtttcaaggcagatga

SEQ ID NO: 86344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catctttgttgtttcaaggc

SEQ ID NO: 86345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatctttgttgtttcaag

SEQ ID NO: 86346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccatctttgttgtttcaa

SEQ ID NO: 86347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctccatctttgttgtttc

SEQ ID NO: 86348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaaggtattcttctccat

SEQ ID NO: 86349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtaaggtattcttctcca

SEQ ID NO: 86350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatttcagtaaggtattct

SEQ ID NO: 86351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatatttcagtaaggtat

SEQ ID NO: 86352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcatatttcagtaaggta

SEQ ID NO: 86353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttattcatatttcagtaag

SEQ ID NO: 86354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaagcccagaggagcagga

SEQ ID NO: 86355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcaaaagcccagaggagca

SEQ ID NO: 86356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccacagcagcacaggttact

SEQ ID NO: 86357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctcccacagcagcacaggt

SEQ ID NO: 86358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgaagtggtaatacaaatt

SEQ ID NO: 86359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacgaagtggtaatacaaat

SEQ ID NO: 86360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacgaagtggtaatacaaa

SEQ ID NO: 86361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcacgaagtggtaatacaa

SEQ ID NO: 86362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttcacgaagtggtaatac

SEQ ID NO: 86363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcttttcacgaagtggtaa

SEQ ID NO: 86364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcttttcacgaagtggta

SEQ ID NO: 86365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttactcttttcacgaagtg

SEQ ID NO: 86366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttactcttttcacgaagt

SEQ ID NO: 86367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgtttactcttttcacga

SEQ ID NO: 86368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttgtttactcttttcacg

SEQ ID NO: 86369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgcttgtttactcttttca

SEQ ID NO: 86370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgcttgtttactcttttc

SEQ ID NO: 86371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgcttgtttactctttt

SEQ ID NO: 86372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcttgcttgtttactct

SEQ ID NO: 86373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttcttgcttgtttactc

SEQ ID NO: 86374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttttcttgcttgtttac

SEQ ID NO: 86375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actcttgttttcttgcttgt

SEQ ID NO: 86376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcaggggaaaggggatag

SEQ ID NO: 86377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaaggcaggggaaagggg

SEQ ID NO: 86378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaattgattaaggcaggg

SEQ ID NO: 86379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaattgattaaggcagg

SEQ ID NO: 86380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaaattgattaaggcag

SEQ ID NO: 86381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagaaattgattaaggca

SEQ ID NO: 86382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgagaaattgattaaggc

SEQ ID NO: 86383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggtctttttgagaaattga

SEQ ID NO: 86384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggcctatggtctttttgag

SEQ ID NO: 86385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggcctatggtctttttga

SEQ ID NO: 86386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggcctatggtctttttg

SEQ ID NO: 86387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatggcctatggtcttttt

SEQ ID NO: 86388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttttatggcctatggtc

SEQ ID NO: 86389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcaatttttatggcctatg

SEQ ID NO: 86390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatgatctattcaattttt

SEQ ID NO: 86391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatgatctattcaatttt

SEQ ID NO: 86392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgatgatctattcaattt

SEQ ID NO: 86393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtgatgatctattcaatt

SEQ ID NO: 86394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataatgagaagacttttgt

SEQ ID NO: 86395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacctaaataatgagaagac

SEQ ID NO: 86396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttagacctaaataatgaga

SEQ ID NO: 86397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttagacctaaataatgag

SEQ ID NO: 86398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatttagttagacctaaat

SEQ ID NO: 86399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaatttagttagacctaaa

SEQ ID NO: 86400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttggaatttagttagac

SEQ ID NO: 86401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcatttggaatttagtta

SEQ ID NO: 86402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattgcatttggaatttag

SEQ ID NO: 86403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattgcatttggaattta

SEQ ID NO: 86404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctattgcatttggaattt

SEQ ID NO: 86405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatctttgctattgcattt

SEQ ID NO: 86406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgataatactatgatcttt

SEQ ID NO: 86407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgataatactatgatctt

SEQ ID NO: 86408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgagggagaagaaaagttt

SEQ ID NO: 86409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaatgagggagaagaaaa

SEQ ID NO: 86410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacaggttcactaatgagg

SEQ ID NO: 86411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagacaagtatgagaaatg

SEQ ID NO: 86412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagacaagtatgagaaat

SEQ ID NO: 86413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaagacaagtatgagaaa

SEQ ID NO: 86414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccaagacaagtatgagaa

SEQ ID NO: 86415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggcttttccaagacaagta

SEQ ID NO: 86416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agataaataaaaggtattca

SEQ ID NO: 86417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgagataaataaaaggtat

SEQ ID NO: 86418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgagataaataaaaggta

SEQ ID NO: 86419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctgagataaataaaaggt

SEQ ID NO: 86420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgctgagataaataaaa

SEQ ID NO: 86421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttgctgagataaataaa

SEQ ID NO: 86422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatcttactttgctgagat

SEQ ID NO: 86423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattaaaatcttacttt

SEQ ID NO: 86424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatattaaaatcttactt

SEQ ID NO: 86425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaatattaaaatcttact

SEQ ID NO: 86426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttaaaatattaaaatctt

SEQ ID NO: 86427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgttttaaaatattaaa

SEQ ID NO: 86428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacagtattgagttgtttta

SEQ ID NO: 86429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctggacagtattgagttgtt

SEQ ID NO: 86430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactggacagtattgagttg

SEQ ID NO: 86431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactggacagtattgagtt

SEQ ID NO: 86432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctactggacagtattgagt

SEQ ID NO: 86433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacattttctactggacag

SEQ ID NO: 86434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatacattttctactggaca

SEQ ID NO: 86435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaagtttaatacattttct

SEQ ID NO: 86436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaagtttaatacattttc

SEQ ID NO: 86437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taagaagtttaatacatttt

SEQ ID NO: 86438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtactttaagaagtttaat

SEQ ID NO: 86439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtattatgtactttaaga

SEQ ID NO: 86440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acggctcaagtattatgtac

SEQ ID NO: 86441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacggctcaagtattatgta

SEQ ID NO: 86442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacggctcaagtattatgt

SEQ ID NO: 86443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtctttgacggctcaag

SEQ ID NO: 86444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaggcccatctgtgtgtctt

SEQ ID NO: 86445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagaaatgcccctagaggc

SEQ ID NO: 86446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaggagaaatgcccctaga

SEQ ID NO: 86447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaggagaaatgcccctag

SEQ ID NO: 86448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatttattaggagaaatgc

SEQ ID NO: 86449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcagagcatctcacattta

SEQ ID NO: 86450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcagagcatctcacattt

SEQ ID NO: 86451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagcttgagcagagcatct

SEQ ID NO: 86452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagcttgagcagagcatc

SEQ ID NO: 86453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccagcttgagcagagcat

SEQ ID NO: 86454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccagcttgagcagagca

SEQ ID NO: 86455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcccagcttgagcagagc

SEQ ID NO: 86456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaacaggagatacatatt

SEQ ID NO: 86457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaaacaggagatacatat

SEQ ID NO: 86458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcacaaacaggagatacata

SEQ ID NO: 86459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaccatatctttcacaaaca

SEQ ID NO: 86460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagggtagcagctgaacca

SEQ ID NO: 86461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtcagggtagcagctgaa

SEQ ID NO: 86462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtcagggtagcagctga

SEQ ID NO: 86463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgtcagggtagcagctg

SEQ ID NO: 86464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttgttgtcagggtagca

SEQ ID NO: 86465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttttgttgtcagggtagc

SEQ ID NO: 86466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtgcttggttttgttgtc

SEQ ID NO: 86467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcactaatgtgcttggtt

SEQ ID NO: 86468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtcactaatgtgcttggt

SEQ ID NO: 86469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtcccttaggtcactaat

SEQ ID NO: 86470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcagtcccttaggtcacta

SEQ ID NO: 86471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtcaaacaatagcaggta

SEQ ID NO: 86472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgtcaaacaatagcaggt

SEQ ID NO: 86473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgtcaaacaatagcagg

SEQ ID NO: 86474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggtgtcaaacaatagcag

SEQ ID NO: 86475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttggtgtcaaacaatag

SEQ ID NO: 86476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caattccttttggtgtcaaa

SEQ ID NO: 86477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaattccttttggtgtcaa

SEQ ID NO: 86478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaagtttccaattcctttt

SEQ ID NO: 86479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaagtttccaattccttt

SEQ ID NO: 86480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catatttagtaagtttccaa

SEQ ID NO: 86481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctccatatttagtaagtttc

SEQ ID NO: 86482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacctgctccatatttagta

SEQ ID NO: 86483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcacctgctccatatttag

SEQ ID NO: 86484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgcacctgctccatattt

SEQ ID NO: 86485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgcacctgctccatatt

SEQ ID NO: 86486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagagaacaatgataggttt

SEQ ID NO: 86487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagagaacaatgataggtt

SEQ ID NO: 86488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagagagaacaatgataggt

SEQ ID NO: 86489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacccacgctttagagagaa

SEQ ID NO: 86490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccacctgaacccacgcttta

SEQ ID NO: 86491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcccacctgaacccacgc

SEQ ID NO: 86492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattcccacctgaacccacg

SEQ ID NO: 86493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgagcttgattcccacct

SEQ ID NO: 86494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgagcttgattcccacc

SEQ ID NO: 86495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgagcttgattcccac

SEQ ID NO: 86496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaatgagcttgattccca

SEQ ID NO: 86497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatcatatacttttcaat

SEQ ID NO: 86498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatcatatacttttcaa

SEQ ID NO: 86499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatatcatatacttttca

SEQ ID NO: 86500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatatatcatatacttttc

SEQ ID NO: 86501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtacttttatatatcatat

SEQ ID NO: 86502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatgtacttttatatatca

SEQ ID NO: 86503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatgtacttttatatatc

SEQ ID NO: 86504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattatgtacttttatatat

SEQ ID NO: 86505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catactttattatgtacttt

SEQ ID NO: 86506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcacaaattacatactttat

SEQ ID NO: 86507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatcacaaattacatactt

SEQ ID NO: 86508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctactatcacaaattaca

SEQ ID NO: 86509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctactatcacaaattac

SEQ ID NO: 86510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctactatcacaaatta

SEQ ID NO: 86511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcacctactatcacaaatt

SEQ ID NO: 86512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttttcacctactatcaca

SEQ ID NO: 86513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggcttttcacctactatc

SEQ ID NO: 86514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctggcttttcacctacta

SEQ ID NO: 86515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctcctggcttttcaccta

SEQ ID NO: 86516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgttcctctcctggctttt

SEQ ID NO: 86517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgttcctctcctggctt

SEQ ID NO: 86518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatgttcctctcctggct

SEQ ID NO: 86519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgatgttcctctcctggc

SEQ ID NO: 86520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtctttctgatgttcctct

SEQ ID NO: 86521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtctttctgatgttcctc

SEQ ID NO: 86522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtctttctgatgttcct

SEQ ID NO: 86523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgtctttctgatgttcc

SEQ ID NO: 86524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttttgtgtctttctgat

SEQ ID NO: 86525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatttttgtgtctttctg

SEQ ID NO: 86526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtatttttgtgtctttct

SEQ ID NO: 86527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtatttttgtgtctttc

SEQ ID NO: 86528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgtatttttgtgtcttt

SEQ ID NO: 86529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttctgtatttttgtgtc

SEQ ID NO: 86530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaaatgtctgtttttctg

SEQ ID NO: 86531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgtgcaaatgtctgttttt

SEQ ID NO: 86532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaactattgtgcaaatgtc

SEQ ID NO: 86533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaaactattgtgcaaatg

SEQ ID NO: 86534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaaaactattgtgcaaat

SEQ ID NO: 86535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaaaactattgtgcaaa

SEQ ID NO: 86536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctcaaaactattgtgcaa

SEQ ID NO: 86537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgcttttctcaaaactat

SEQ ID NO: 86538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgcttttctcaaaacta

SEQ ID NO: 86539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacaatttaaatgcttttc

SEQ ID NO: 86540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgtgaggttcaaacaattt

SEQ ID NO: 86541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctagtgtgaggttcaaaca

SEQ ID NO: 86542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtctagtgtgaggttcaaa

SEQ ID NO: 86543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagttctgtctagtgtgag

SEQ ID NO: 86544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagagttctgtctagtgtga

SEQ ID NO: 86545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcagagttctgtctagtgt

SEQ ID NO: 86546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatatccatctcttcagag

SEQ ID NO: 86547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaatatccatctcttcaga

SEQ ID NO: 86548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttgaaatatccatctctt

SEQ ID NO: 86549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttgaaatatccatctct

SEQ ID NO: 86550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttgaaatatccatctc

SEQ ID NO: 86551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatttgaaatatccatct

SEQ ID NO: 86552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatttgaaatatccatc

SEQ ID NO: 86553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttcatttgaaatatcc

SEQ ID NO: 86554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttcatttgaaatatc

SEQ ID NO: 86555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttcatttgaaatat

SEQ ID NO: 86556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttattttttcatttgaaa

SEQ ID NO: 86557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctattttattttttcattt

SEQ ID NO: 86558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagtcccaattccctattt

SEQ ID NO: 86559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcccagtcccaattccct

SEQ ID NO: 86560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtggagaaatgggacaga

SEQ ID NO: 86561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagtggacaaggcagatg

SEQ ID NO: 86562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaagtggacaaggcagat

SEQ ID NO: 86563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaagtggacaaggcaga

SEQ ID NO: 86564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatattttaaaaagtgga

SEQ ID NO: 86565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taataactaaaaatatttta

SEQ ID NO: 86566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcatcactgtaataactaa

SEQ ID NO: 86567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcagcatcactgtaataa

SEQ ID NO: 86568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagttcagcatcactgtaa

SEQ ID NO: 86569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attagttcagcatcactgta

SEQ ID NO: 86570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattagttcagcatcactg

SEQ ID NO: 86571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacaccattcttattagttc

SEQ ID NO: 86572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaacaccattcttattagt

SEQ ID NO: 86573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctaaacaccattcttatta

SEQ ID NO: 86574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctaaacaccattcttat

SEQ ID NO: 86575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgttctctctaaacaccatt

SEQ ID NO: 86576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgttctctctaaacaccat

SEQ ID NO: 86577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatgttctctctaaacacc

SEQ ID NO: 86578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttatgttctctctaaacac

SEQ ID NO: 86579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttatgttctctctaaac

SEQ ID NO: 86580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcttcttatgttctctcta

SEQ ID NO: 86581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcttcttatgttctctct

SEQ ID NO: 86582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaatttactcttcttatgtt

SEQ ID NO: 86583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaaatttactcttcttatg

SEQ ID NO: 86584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacagactctcaaatttact

SEQ ID NO: 86585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agacagactctcaaatttac

SEQ ID NO: 86586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagacagactctcaaattta

SEQ ID NO: 86587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagattttagacagactctc

SEQ ID NO: 86588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaagacggcaagagtgatg

SEQ ID NO: 86589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaaataaaagatcccaa

SEQ ID NO: 86590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaacaacagaatactcaaa

SEQ ID NO: 86591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggtgtaattggaaacaac

SEQ ID NO: 86592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccagaagttgtaggtgtaat

SEQ ID NO: 86593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccagaagttgtaggtgtaa

SEQ ID NO: 86594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccagaagttgtaggtgta

SEQ ID NO: 86595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgccagaagttgtaggtgt

SEQ ID NO: 86596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgccagaagttgtaggtg

SEQ ID NO: 86597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttttgccagaagttgt

SEQ ID NO: 86598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttttgccagaagttg

SEQ ID NO: 86599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattttttgccagaagtt

SEQ ID NO: 86600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtattttatattttttgc

SEQ ID NO: 86601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaagtattttatattttt

SEQ ID NO: 86602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtcctattaaagtatttt

SEQ ID NO: 86603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgtcctattaaagtattt

SEQ ID NO: 86604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttgatgtcctattaaagta

SEQ ID NO: 86605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaataattacttgatgtcct

SEQ ID NO: 86606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaataattacttgatgtc

SEQ ID NO: 86607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattctgaaataattacttg

SEQ ID NO: 86608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctgtattctgaaataatt

SEQ ID NO: 86609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catctgtattctgaaataat

SEQ ID NO: 86610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatctgtattctgaaataa

SEQ ID NO: 86611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcatctgtattctgaaa

SEQ ID NO: 86612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaaattattttcatctgta

SEQ ID NO: 86613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacaatgctatgaaattat

SEQ ID NO: 86614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggacaatgctatgaaatta

SEQ ID NO: 86615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatttaggacaatgctatga

SEQ ID NO: 86616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggatttaggacaatgctat

SEQ ID NO: 86617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaaccctctggatttagg

SEQ ID NO: 86618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagcaatgattcatgaacc

SEQ ID NO: 86619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagagcaatgattcatgaa

SEQ ID NO: 86620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagagcaatgattcatga

SEQ ID NO: 86621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctaagagcaatgattcatg

SEQ ID NO: 86622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgtcaagagctttctaag

SEQ ID NO: 86623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcccctgggtgtcaagagct

SEQ ID NO: 86624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catgaaaacctatcccctgg

SEQ ID NO: 86625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcatgaaaacctatcccct

SEQ ID NO: 86626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcatgaaaacctatcccc

SEQ ID NO: 86627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgcatgaaaacctatccc

SEQ ID NO: 86628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagggtgattttctgcatg

SEQ ID NO: 86629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atctcccagggtgattttct

SEQ ID NO: 86630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcatgttgatctcccaggg

SEQ ID NO: 86631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacatgaggtacatcaacca

SEQ ID NO: 86632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtacatgaggtacatcaacc

SEQ ID NO: 86633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtcaggagaaacaaacaca

SEQ ID NO: 86634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaagtcaggagaaacaaac

SEQ ID NO: 86635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actaagtcaggagaaacaaa

SEQ ID NO: 86636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactaagtcaggagaaacaa

SEQ ID NO: 86637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttactaagtcaggagaaac

SEQ ID NO: 86638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatagctctttactaagtca

SEQ ID NO: 86639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatagctctttactaagtc

SEQ ID NO: 86640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaaccaggggtccactta

SEQ ID NO: 86641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctccccaaccaggggtccac

SEQ ID NO: 86642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctccccaaccaggggtcca

SEQ ID NO: 86643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctccccaaccaggggtcc

SEQ ID NO: 86644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggctttcctccccaacca

SEQ ID NO: 86645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatagcacagaactcaaggc

SEQ ID NO: 86646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaatagcacagaactcaag

SEQ ID NO: 86647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaggcattctaaatagcac

SEQ ID NO: 86648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttgagaggcattctaaata

SEQ ID NO: 86649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttgagaggcattctaaat

SEQ ID NO: 86650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaagcatttagttgagagg

SEQ ID NO: 86651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attacaaagcatttagttga

SEQ ID NO: 86652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaattacaaagcatttag

SEQ ID NO: 86653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagttaattacaaagcat

SEQ ID NO: 86654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaacattaattagttaatt

SEQ ID NO: 86655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaaaaatgatggaatagt

SEQ ID NO: 86656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcaggaaaaatgatggaat

SEQ ID NO: 86657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactcaggaaaaatgatgg

SEQ ID NO: 86658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactcaggaaaaatgatg

SEQ ID NO: 86659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtgtttattactcaggaa

SEQ ID NO: 86660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgtgtttattactcagga

SEQ ID NO: 86661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atataaagtcttaatgtgtt

SEQ ID NO: 86662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catataaagtcttaatgtgt

SEQ ID NO: 86663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttcatataaagtcttaatg

SEQ ID NO: 86664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attacttcatataaagtctt

SEQ ID NO: 86665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgattacttcatataaagt

SEQ ID NO: 86666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgattacttcatataaag

SEQ ID NO: 86667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgtgtcatcatttattgatt

SEQ ID NO: 86668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccgtgtcatcatttattgat

SEQ ID NO: 86669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccgtgtcatcatttattga

SEQ ID NO: 86670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttccgtgtcatcatttat

SEQ ID NO: 86671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttccgtgtcatcattta

SEQ ID NO: 86672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatttgttttccgtgtcatc

SEQ ID NO: 86673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggatttgttttccgtgtc

SEQ ID NO: 86674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctggatttgttttccgtgt

SEQ ID NO: 86675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacacttcctggatttgttt

SEQ ID NO: 86676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agacacttcctggatttgtt

SEQ ID NO: 86677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggtaatttagacacttcc

SEQ ID NO: 86678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccagtgaattccaggtaatt

SEQ ID NO: 86679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctaccagtgaattccaggt

SEQ ID NO: 86680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgattggctaccagtgaatt

SEQ ID NO: 86681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttacgattggctaccagt

SEQ ID NO: 86682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaagaatggggctgggtta

SEQ ID NO: 86683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgcctgtgaagaatgggg

SEQ ID NO: 86684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgcctgtgaagaatggg

SEQ ID NO: 86685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatgcctgtgaagaatgg

SEQ ID NO: 86686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggcatgaactttaaatgcc

SEQ ID NO: 86687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtggcatgaactttaaatg

SEQ ID NO: 86688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattctgtggcatgaacttt

SEQ ID NO: 86689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattctgtggcatgaactt

SEQ ID NO: 86690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaattctgtggcatgaact

SEQ ID NO: 86691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaattctgtggcatgaa

SEQ ID NO: 86692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatcagagtgtaacagcctc

SEQ ID NO: 86693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatcagagtgtaacagcc

SEQ ID NO: 86694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaagttctagatcagagt

SEQ ID NO: 86695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatacaagttctagatcag

SEQ ID NO: 86696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attatacaagttctagatca

SEQ ID NO: 86697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaccttattatacaagtt

SEQ ID NO: 86698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgaccttattatacaagt

SEQ ID NO: 86699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcatgaccttattatacaa

SEQ ID NO: 86700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcttcatgaccttattat

SEQ ID NO: 86701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctcttcatgaccttatta

SEQ ID NO: 86702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtctcttcatgaccttatt

SEQ ID NO: 86703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttgtctcttcatgacctt

SEQ ID NO: 86704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctcctttgtctcttcatg

SEQ ID NO: 86705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcctcctttgtctcttcat

SEQ ID NO: 86706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatttatcctcctttgtc

SEQ ID NO: 86707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatttatcctcctttgt

SEQ ID NO: 86708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatatttatcctcctttg

SEQ ID NO: 86709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatatttatcctccttt

SEQ ID NO: 86710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaatatttatcctcctt

SEQ ID NO: 86711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaatatttatcctcct

SEQ ID NO: 86712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaatatttatcctcc

SEQ ID NO: 86713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaaatatttatcctc

SEQ ID NO: 86714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtgtttttttttaaatatt

SEQ ID NO: 86715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgatcctatgtgtttttttt

SEQ ID NO: 86716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcactccgatcctatgtgtt

SEQ ID NO: 86717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctggcactccgatcctatg

SEQ ID NO: 86718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctggcactccgatcctat

SEQ ID NO: 86719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctggcactccgatccta

SEQ ID NO: 86720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gacaccatgtattttatctg

SEQ ID NO: 86721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatatgactagacaccatg

SEQ ID NO: 86722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaattcaaatatgactagac

SEQ ID NO: 86723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctggaattcaaatatgact

SEQ ID NO: 86724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctggaattcaaatatgac

SEQ ID NO: 86725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacttatctggaattcaaat

SEQ ID NO: 86726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtaggtcctggacttatct

SEQ ID NO: 86727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatgtaggtcctggactta

SEQ ID NO: 86728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctatgtaggtcctggactt

SEQ ID NO: 86729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaatttcctatgtaggtcc

SEQ ID NO: 86730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaaagttgccaatttcct

SEQ ID NO: 86731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacatgcctgtgaaaagtt

SEQ ID NO: 86732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaacatgcctgtgaaaag

SEQ ID NO: 86733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggaacatgcctgtgaaaa

SEQ ID NO: 86734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtccttctggaacatgcctg

SEQ ID NO: 86735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtccttctggaacatgcct

SEQ ID NO: 86736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccataggaaaaaggtttggt

SEQ ID NO: 86737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccataggaaaaaggtttgg

SEQ ID NO: 86738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccatcttgccataggaaaaa

SEQ ID NO: 86739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagaacctaccatcttgcc

SEQ ID NO: 86740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagagaagctggaagaacc

SEQ ID NO: 86741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagcagagaagctggaaga

SEQ ID NO: 86742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagccacagattgttagcag

SEQ ID NO: 86743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggagccacagattgttagc

SEQ ID NO: 86744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctggagccacagattgtta

SEQ ID NO: 86745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctctggagccacagattg

SEQ ID NO: 86746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctctctggagccacagatt

SEQ ID NO: 86747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctctctggagccacaga

SEQ ID NO: 86748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcttcctctctggagcca

SEQ ID NO: 86749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctcttcctctctggagcc

SEQ ID NO: 86750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgcctcttcctctctggag

SEQ ID NO: 86751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcatcctcttgcctcttcct

SEQ ID NO: 86752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctggcatcctcttgcctct

SEQ ID NO: 86753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgctacctggcatcctct

SEQ ID NO: 86754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgagttacatgctacctgg

SEQ ID NO: 86755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcatgagttacatgctac

SEQ ID NO: 86756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggctcatgagttacatg

SEQ ID NO: 86757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattggctcatgagttacat

SEQ ID NO: 86758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattggctcatgagttaca

SEQ ID NO: 86759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttcattggctcatgagt

SEQ ID NO: 86760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actaattttcattggctcat

SEQ ID NO: 86761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggtggtatattaactaatt

SEQ ID NO: 86762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacatgtgctaaggtggtat

SEQ ID NO: 86763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggaaaaatgtacatgata

SEQ ID NO: 86764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaggaaaaatgtacatgat

SEQ ID NO: 86765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttgtaggaaaaatgtaca

SEQ ID NO: 86766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttgtaggaaaaatgtac

SEQ ID NO: 86767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtttgtaggaaaaatgt

SEQ ID NO: 86768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcttagtttgtaggaaaaa

SEQ ID NO: 86769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattcttagtttgtaggaaa

SEQ ID NO: 86770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattcttagtttgtaggaa

SEQ ID NO: 86771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctattcttagtttgtagga

SEQ ID NO: 86772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagactttctattcttagt

SEQ ID NO: 86773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttggaagactttctatt

SEQ ID NO: 86774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgttggaagactttctat

SEQ ID NO: 86775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgttggaagactttcta

SEQ ID NO: 86776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgttggaagactttct

SEQ ID NO: 86777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatgttggaagactttc

SEQ ID NO: 86778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaatgttggaagacttt

SEQ ID NO: 86779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaatgttggaagactt

SEQ ID NO: 86780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaatgttggaagact

SEQ ID NO: 86781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttaatgttggaagac

SEQ ID NO: 86782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttaatgttggaaga

SEQ ID NO: 86783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttaatgttggaag

SEQ ID NO: 86784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcattttttttttttaatgt

SEQ ID NO: 86785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcattttttttttttaatg

SEQ ID NO: 86786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgtcatttttttttttta

SEQ ID NO: 86787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaaatagctacttgtcatt

SEQ ID NO: 86788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctggaaaatagctacttg

SEQ ID NO: 86789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggggcatatctaggctgga

SEQ ID NO: 86790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggggcatatctaggctgg

SEQ ID NO: 86791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggaacttgaggggcatatc

SEQ ID NO: 86792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggaacttgaggggcatat

SEQ ID NO: 86793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtttgtggaacttgaggg

SEQ ID NO: 86794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataagagtatatgaaaaa

SEQ ID NO: 86795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgagcgggttaaaataag

SEQ ID NO: 86796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgagcgggttaaaataa

SEQ ID NO: 86797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaatcatttaaatgagcgg

SEQ ID NO: 86798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actggcaatcatttaaatga

SEQ ID NO: 86799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgactggcaatcatttaaa

SEQ ID NO: 86800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctactgactggcaatcatt

SEQ ID NO: 86801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcactggctactgactggca

SEQ ID NO: 86802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagcactggctactgactg

SEQ ID NO: 86803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactagcactggctactga

SEQ ID NO: 86804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attactagcactggctactg

SEQ ID NO: 86805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattactagcactggctact

SEQ ID NO: 86806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattactagcactggctac

SEQ ID NO: 86807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttattactagcactggcta

SEQ ID NO: 86808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagggagtaaatggtactt

SEQ ID NO: 86809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttcccagggagtaaatgg

SEQ ID NO: 86810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagttcccagggagtaaat

SEQ ID NO: 86811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctgagttcccagggagta

SEQ ID NO: 86812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tattctgagttcccagggag

SEQ ID NO: 86813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctattctgagttcccagg

SEQ ID NO: 86814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatgttactctattctgagt

SEQ ID NO: 86815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attagatgttactctattct

SEQ ID NO: 86816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgattagatgttactctat

SEQ ID NO: 86817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgattagatgttactcta

SEQ ID NO: 86818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagtataatcaatagccc

SEQ ID NO: 86819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaagtataatcaatagcc

SEQ ID NO: 86820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttagaaagtataatcaat

SEQ ID NO: 86821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggttgatttagaaagtata

SEQ ID NO: 86822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggttgatttagaaagtat

SEQ ID NO: 86823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatagtacagataaaagat

SEQ ID NO: 86824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagaccattgtgatagtaca

SEQ ID NO: 86825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagaccattgtgatagtac

SEQ ID NO: 86826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagacttggagaccattgtg

SEQ ID NO: 86827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggataagacaaaatgagag

SEQ ID NO: 86828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtggataagacaaaatgag

SEQ ID NO: 86829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatattctgtggataagaca

SEQ ID NO: 86830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagtactatatattctgtg

SEQ ID NO: 86831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgacagtactatatattctg

SEQ ID NO: 86832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccactctgacagtactatat

SEQ ID NO: 86833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaccactctgacagtact

SEQ ID NO: 86834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaccactctgacagtac

SEQ ID NO: 86835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattaccactctgacagta

SEQ ID NO: 86836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattaccactctgacagt

SEQ ID NO: 86837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagaagagagatgtgatca

SEQ ID NO: 86838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacagaagagagatgtgatc

SEQ ID NO: 86839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacagaagagagatgtgat

SEQ ID NO: 86840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacagaagagagatgtga

SEQ ID NO: 86841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaacagaagagagatgtg

SEQ ID NO: 86842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgattttttaacagaagag

SEQ ID NO: 86843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagccactgatgattttt

SEQ ID NO: 86844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgagaagccactgatgatt

SEQ ID NO: 86845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcccataagctattgagaa

SEQ ID NO: 86846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggttaatcccataagcta

SEQ ID NO: 86847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgggttaatcccataagct

SEQ ID NO: 86848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacaggcccttgtgggtta

SEQ ID NO: 86849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggacaggcccttgtgggtt

SEQ ID NO: 86850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaccacttaggacaggccc

SEQ ID NO: 86851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggctgggaccacttaggaca

SEQ ID NO: 86852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gataggtgggtgggaatgag

SEQ ID NO: 86853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtcctagataggtgggtgg

SEQ ID NO: 86854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtcctagataggtgggtg

SEQ ID NO: 86855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggatcttgagtcctagatag

SEQ ID NO: 86856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctaggatcttgagtcctag

SEQ ID NO: 86857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagcatagccacctatctag

SEQ ID NO: 86858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttggagcatagccacctatc

SEQ ID NO: 86859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgccctattggagcata

SEQ ID NO: 86860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agggaagaattaaaatgccc

SEQ ID NO: 86861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgagggaagaattaaaatg

SEQ ID NO: 86862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctcctgagggaagaattaa

SEQ ID NO: 86863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gactggctcctgagggaaga

SEQ ID NO: 86864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggactggctcctgagggaag

SEQ ID NO: 86865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggactggctcctgaggga

SEQ ID NO: 86866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaactcttggactggctcct

SEQ ID NO: 86867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaactcttggactggctcc

SEQ ID NO: 86868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggtttaaaactcttggac

SEQ ID NO: 86869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaagtagttgtaggttt

SEQ ID NO: 86870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaaaagtagttgtaggtt

SEQ ID NO: 86871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggtttaagaaaagtagtt

SEQ ID NO: 86872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggtttaagaaaagtagt

SEQ ID NO: 86873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaggtttaagaaaagtag

SEQ ID NO: 86874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttggaggtttaagaaaag

SEQ ID NO: 86875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cacccggccactactttgga

SEQ ID NO: 86876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagacgtgagccactgcacc

SEQ ID NO: 86877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattacagacgtgagccac

SEQ ID NO: 86878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgttgggattacag

SEQ ID NO: 86879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcccaaagtgttgggatt

SEQ ID NO: 86880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcctcccaaagtgttggga

SEQ ID NO: 86881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccacctctgcctcccaaag

SEQ ID NO: 86882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtgatctgcccacctctg

SEQ ID NO: 86883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgacctcaagtgatctgccc

SEQ ID NO: 86884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccgacctcaagtgatctgcc

SEQ ID NO: 86885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacttccgacctcaagtgat

SEQ ID NO: 86886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacttccgacctcaagtga

SEQ ID NO: 86887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcttgaacttccgacctca

SEQ ID NO: 86888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcaggctggtcttgaactt

SEQ ID NO: 86889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgttggtcaggctggtct

SEQ ID NO: 86890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatgttggtcaggctggt

SEQ ID NO: 86891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccatgttggtcaggctgg

SEQ ID NO: 86892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagatggagtttctcca

SEQ ID NO: 86893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagatggagtttctcc

SEQ ID NO: 86894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagatggagtttctc

SEQ ID NO: 86895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagatggagtttct

SEQ ID NO: 86896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagtagagatggagtttc

SEQ ID NO: 86897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttagtagagatggagttt

SEQ ID NO: 86898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttagtagagatggagtt

SEQ ID NO: 86899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattttttttagtagagatg

SEQ ID NO: 86900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattttttttagtagagat

SEQ ID NO: 86901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattttttttagtagaga

SEQ ID NO: 86902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgtattttttttagta

SEQ ID NO: 86903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagcacgcgccaccacgcc

SEQ ID NO: 86904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgaggagccgggattataag

SEQ ID NO: 86905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccgaggagccgggattataa

SEQ ID NO: 86906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agccttccgaggagccggga

SEQ ID NO: 86907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagccttccgaggagcc

SEQ ID NO: 86908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagccttccgagga

SEQ ID NO: 86909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagccttccgag

SEQ ID NO: 86910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcgattctcctgcctcag

SEQ ID NO: 86911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttcaagcgattctcctgc

SEQ ID NO: 86912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgggttcaagcgattctcc

SEQ ID NO: 86913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgctcctgggttcaagcgat

SEQ ID NO: 86914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accgcaatctccgctcctgg

SEQ ID NO: 86915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggctcaccgcaatctccgct

SEQ ID NO: 86916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtgcaatggcgtgatctc

SEQ ID NO: 86917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatcctgaagtgcaatgg

SEQ ID NO: 86918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcccatcctgaagtgcaa

SEQ ID NO: 86919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgcccatcctgaagtgca

SEQ ID NO: 86920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttgcccatcctgaagtg

SEQ ID NO: 86921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcttgttgcccatcctgaa

SEQ ID NO: 86922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctcttgttgcccatcctga

SEQ ID NO: 86923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctcttgttgcccatcctg

SEQ ID NO: 86924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acggagttttgctcttgttg

SEQ ID NO: 86925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacggagttttgctcttgtt

SEQ ID NO: 86926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacggagttttgctcttgt

SEQ ID NO: 86927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgacggagttttgctct

SEQ ID NO: 86928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgacggagttttgctc

SEQ ID NO: 86929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgttttgacggagttttg

SEQ ID NO: 86930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgttttgacggagtttt

SEQ ID NO: 86931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttgttttgacggagt

SEQ ID NO: 86932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttgttttgacggag

SEQ ID NO: 86933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttgtttgttttgacg

SEQ ID NO: 86934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttgtttgttttgac

SEQ ID NO: 86935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttgtttgtttgtttt

SEQ ID NO: 86936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttgtttgtttgttt

SEQ ID NO: 86937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttgtttgtttgtttg

SEQ ID NO: 86938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttgtttgtttgttt

SEQ ID NO: 86939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttgtttgtttgtttgtttg

SEQ ID NO: 86940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttgtttgtttgtttgttt

SEQ ID NO: 86941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttgtttgtttgtttgtt

SEQ ID NO: 86942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtttgtttgtttgtttgt

SEQ ID NO: 86943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtttgtttgtttgtttg

SEQ ID NO: 86944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcaaatcatgatgagagg

SEQ ID NO: 86945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggggagggtgattatgtcaa

SEQ ID NO: 86946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggggagggtgattatgtca

SEQ ID NO: 86947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatatgggagtagaaagatg

SEQ ID NO: 86948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggctaaatatgggagtagaa

SEQ ID NO: 86949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtaccccattgggctaaat

SEQ ID NO: 86950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtaccccattgggctaa

SEQ ID NO: 86951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatgtaccccattgggcta

SEQ ID NO: 86952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccttctatgtaccccattgg

SEQ ID NO: 86953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaccttctatgtacccca

SEQ ID NO: 86954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgattaccttctatgtacc

SEQ ID NO: 86955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgattaccttctatgtac

SEQ ID NO: 86956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataagtatttattgattac

SEQ ID NO: 86957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtaaggaatagagaaaga

SEQ ID NO: 86958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtaaggaatagagaaag

SEQ ID NO: 86959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagtaaggaatagagaaa

SEQ ID NO: 86960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagtaaggaatagagaa

SEQ ID NO: 86961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaagtaaggaatagaga

SEQ ID NO: 86962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttaaagtaaggaataga

SEQ ID NO: 86963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttttaaagtaaggaatag

SEQ ID NO: 86964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctttttaaagtaaggaa

SEQ ID NO: 86965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttctttttaaagtaagga

SEQ ID NO: 86966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttccttctttttaaagtaa

SEQ ID NO: 86967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttccttctttttaaagt

SEQ ID NO: 86968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttccttctttttaaag

SEQ ID NO: 86969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtttccttctttttaaa

SEQ ID NO: 86970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgtttccttctttttaa

SEQ ID NO: 86971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctgtttccttcttttta

SEQ ID NO: 86972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actttttctgtttccttctt

SEQ ID NO: 86973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactttttctgtttccttc

SEQ ID NO: 86974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcactttttctgtttcctt

SEQ ID NO: 86975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcactttttctgtttcct

SEQ ID NO: 86976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctcactttttctgtttc

SEQ ID NO: 86977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactctttctcactttttct

SEQ ID NO: 86978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaactctttctcactttttc

SEQ ID NO: 86979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaactctttctcacttttt

SEQ ID NO: 86980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattttgaactctttctcac

SEQ ID NO: 86981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acattttgaactctttctca

SEQ ID NO: 86982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttacattttgaactctttc

SEQ ID NO: 86983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccttacattttgaactc

SEQ ID NO: 86984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggttccttacattttga

SEQ ID NO: 86985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattggttccttacattttg

SEQ ID NO: 86986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattggttccttacatttt

SEQ ID NO: 86987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcattggttccttacatt

SEQ ID NO: 86988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcattggttccttacat

SEQ ID NO: 86989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttcattggttccttaca

SEQ ID NO: 86990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttcattggttccttac

SEQ ID NO: 86991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctttcattggttcctta

SEQ ID NO: 86992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttctttcattggttcct

SEQ ID NO: 86993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttctttcattggttcc

SEQ ID NO: 86994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttctttcattggttc

SEQ ID NO: 86995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttttctttcattggtt

SEQ ID NO: 86996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttttctttcattggt

SEQ ID NO: 86997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctttttctttcattgg

SEQ ID NO: 86998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacttttttctttttcttt

SEQ ID NO: 86999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgacttttttctttttctt

SEQ ID NO: 87000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgacttttttctttttct

SEQ ID NO: 87001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataactttgtgactttttt

SEQ ID NO: 87002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attacataactttgtgactt

SEQ ID NO: 87003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaatgataacaaatacaa

SEQ ID NO: 87004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaaatgataacaaataca

SEQ ID NO: 87005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttagaaaatgataacaaat

SEQ ID NO: 87006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataaataaaatgagacta

SEQ ID NO: 87007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgcataaattgaaataaa

SEQ ID NO: 87008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaaacatatggttcaatg

SEQ ID NO: 87009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaatgaagtggaagtaca

SEQ ID NO: 87010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattgcaaaatgaagtggaa

SEQ ID NO: 87011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaaattgcaaaatgaagtg

SEQ ID NO: 87012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatactcctaaattgcaaa

SEQ ID NO: 87013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accattgaaatactcctaaa

SEQ ID NO: 87014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaccattgaaatactccta

SEQ ID NO: 87015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgaccattgaaatactcc

SEQ ID NO: 87016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgaccattgaaatactc

SEQ ID NO: 87017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctgaccattgaaatact

SEQ ID NO: 87018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttctctgaccattgaaa

SEQ ID NO: 87019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttctctgaccattgaa

SEQ ID NO: 87020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcattttctctgaccattga

SEQ ID NO: 87021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagtactttcattttctct

SEQ ID NO: 87022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaattaacagtactttcat

SEQ ID NO: 87023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaattaacagtactttca

SEQ ID NO: 87024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaattaacagtactttc

SEQ ID NO: 87025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttcagaattaacagtac

SEQ ID NO: 87026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattttcagaattaacagt

SEQ ID NO: 87027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagagagattctaattttca

SEQ ID NO: 87028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagagagattctaattttc

SEQ ID NO: 87029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtttgtagagagattct

SEQ ID NO: 87030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagtttgtagagagattc

SEQ ID NO: 87031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttaaaagtttgtagagag

SEQ ID NO: 87032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacctaatttaaaagtttg

SEQ ID NO: 87033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaatattgtgacctaattt

SEQ ID NO: 87034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggaatattgtgacctaatt

SEQ ID NO: 87035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggaatattgtgacctaat

SEQ ID NO: 87036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaggaatattgtgacctaa

SEQ ID NO: 87037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtttttaggaatattgtg

SEQ ID NO: 87038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggtttttaggaatattgt

SEQ ID NO: 87039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttagggtttttaggaatat

SEQ ID NO: 87040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtctacttagggttttta

SEQ ID NO: 87041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagtctacttagggttttt

SEQ ID NO: 87042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccttatagtctacttaggg

SEQ ID NO: 87043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgcattgcccttatagt

SEQ ID NO: 87044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatgcattgcccttatag

SEQ ID NO: 87045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccttataatgcattgccct

SEQ ID NO: 87046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagccttataatgcattgcc

SEQ ID NO: 87047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacacggcaactctagcc

SEQ ID NO: 87048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatatacacggcaactcta

SEQ ID NO: 87049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtattgttatatacacgg

SEQ ID NO: 87050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcgtgagccaccatgcc

SEQ ID NO: 87051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaggcgtgagccac

SEQ ID NO: 87052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagtgctgggattacagg

SEQ ID NO: 87053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaagtgctgggattacag

SEQ ID NO: 87054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggccttccaaagtgctggga

SEQ ID NO: 87055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcggccttccaaagtgct

SEQ ID NO: 87056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtgatccacctgcctcgg

SEQ ID NO: 87057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caggtgatccacctgcctcg

SEQ ID NO: 87058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgacttcaggtgatccacc

SEQ ID NO: 87059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaactcccgacttcaggtga

SEQ ID NO: 87060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtctcgaactcccgacttca

SEQ ID NO: 87061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcagactggtctcgaactc

SEQ ID NO: 87062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgttggtcagactggtct

SEQ ID NO: 87063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatgttggtcagactggt

SEQ ID NO: 87064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccatgttggtcagactgg

SEQ ID NO: 87065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacagggtttctcca

SEQ ID NO: 87066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacagggtttctcc

SEQ ID NO: 87067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacagggtttctc

SEQ ID NO: 87068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagacagggtttct

SEQ ID NO: 87069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagacaggg

SEQ ID NO: 87070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagacagg

SEQ ID NO: 87071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagacag

SEQ ID NO: 87072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgtatttttagtagag

SEQ ID NO: 87073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaattttgtatttttagt

SEQ ID NO: 87074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcatgccccaccacgcc

SEQ ID NO: 87075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaggcatgccccac

SEQ ID NO: 87076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtagctgggattacaggca

SEQ ID NO: 87077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgagtagctgggattacag

SEQ ID NO: 87078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcctgagtagctggga

SEQ ID NO: 87079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcctgagtagct

SEQ ID NO: 87080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcctcagcctcctgagtag

SEQ ID NO: 87081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcctcagcctcctgagta

SEQ ID NO: 87082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctgcctcagcctcctgag

SEQ ID NO: 87083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcaattcttctgcctcag

SEQ ID NO: 87084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggttcaagcaattcttc

SEQ ID NO: 87085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgcctcccaggttcaagcaa

SEQ ID NO: 87086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gccacaacctccgcctccca

SEQ ID NO: 87087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcgccacaacctccgcct

SEQ ID NO: 87088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcgccacaacctccgcc

SEQ ID NO: 87089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcaatggcgcaatctt

SEQ ID NO: 87090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcaatgg

SEQ ID NO: 87091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcccaggctggagtgcaa

SEQ ID NO: 87092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgcccaggctggagtgca

SEQ ID NO: 87093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttgcccaggctggagtg

SEQ ID NO: 87094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcttgttgcccaggctgg

SEQ ID NO: 87095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactcttgttgcccaggctg

SEQ ID NO: 87096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagagggagtttcactctt

SEQ ID NO: 87097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgagagggagtttcactct

SEQ ID NO: 87098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgagagggagtttcactc

SEQ ID NO: 87099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgagagggagtttcact

SEQ ID NO: 87100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtgagagggagtttcac

SEQ ID NO: 87101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtgagagggagtttca

SEQ ID NO: 87102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgtgagagggagtttc

SEQ ID NO: 87103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttttgtgagagggagt

SEQ ID NO: 87104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttttgtgagagggag

SEQ ID NO: 87105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttttgtgagaggga

SEQ ID NO: 87106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttttgtgagaggg

SEQ ID NO: 87107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttttttgtgagagg

SEQ ID NO: 87108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttattttttttgtgag

SEQ ID NO: 87109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttattttttttgtga

SEQ ID NO: 87110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttattttttttgtg

SEQ ID NO: 87111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttattttttttgt

SEQ ID NO: 87112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttttattttttttg

SEQ ID NO: 87113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttattttttatttttt

SEQ ID NO: 87114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttattttttattttt

SEQ ID NO: 87115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttattttttatttt

SEQ ID NO: 87116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttattttttattt

SEQ ID NO: 87117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttttattttttatt

SEQ ID NO: 87118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttattttttatttttt

SEQ ID NO: 87119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttattttttattttt

SEQ ID NO: 87120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttattttttatttt

SEQ ID NO: 87121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttattttttattttttat

SEQ ID NO: 87122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttattttttatttttta

SEQ ID NO: 87123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttattttttatttttt

SEQ ID NO: 87124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttattttattttttatt

SEQ ID NO: 87125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaccaagcatgttaattt

SEQ ID NO: 87126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgagaaatattgcagac

SEQ ID NO: 87127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatgagaaatattgcaga

SEQ ID NO: 87128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaatgagaaatattgcag

SEQ ID NO: 87129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagacaagtccacgaaccag

SEQ ID NO: 87130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggcagaggaagttatagac

SEQ ID NO: 87131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attatggcagaggaagttat

SEQ ID NO: 87132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattatggcagaggaagtta

SEQ ID NO: 87133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattatggcagaggaagtt

SEQ ID NO: 87134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgcccagagatactttaat

SEQ ID NO: 87135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgcccagagatactttaa

SEQ ID NO: 87136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgcccagagatacttta

SEQ ID NO: 87137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtgcccagagatacttt

SEQ ID NO: 87138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaatgtttttggtgcccag

SEQ ID NO: 87139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaatgtttttggtgccca

SEQ ID NO: 87140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtaaatgtttttggtgccc

SEQ ID NO: 87141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagcagtcattttgtaaat

SEQ ID NO: 87142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatcatagttgaaagcagt

SEQ ID NO: 87143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgacatcatagttgaaagc

SEQ ID NO: 87144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgacatcatagttgaaag

SEQ ID NO: 87145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgacatcatagttgaaa

SEQ ID NO: 87146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagtataaggaattttattg

SEQ ID NO: 87147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagtataaggaattttatt

SEQ ID NO: 87148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagtataaggaattttat

SEQ ID NO: 87149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtagtataaggaatttta

SEQ ID NO: 87150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccatgcaggaataatagaa

SEQ ID NO: 87151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtaaattatccatgcaggaa

SEQ ID NO: 87152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctggtaaattatccatgcag

SEQ ID NO: 87153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattactggtaaattatcca

SEQ ID NO: 87154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaattactggtaaattatcc

SEQ ID NO: 87155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataaaaagcttgaattact

SEQ ID NO: 87156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acataaaaagcttgaattac

SEQ ID NO: 87157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttacataaaaagcttgaat

SEQ ID NO: 87158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccttacataaaaagcttga

SEQ ID NO: 87159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctccttacataaaaagctt

SEQ ID NO: 87160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatctctctccttacata

SEQ ID NO: 87161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgataatctctctccttaca

SEQ ID NO: 87162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgataatctctctccttac

SEQ ID NO: 87163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgataatctctctcctta

SEQ ID NO: 87164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgataatctctctcctt

SEQ ID NO: 87165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggggcatccccatagttt

SEQ ID NO: 87166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggaggggcatccccatag

SEQ ID NO: 87167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggcagaatgcccagacaa

SEQ ID NO: 87168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaaaggcagaatgcccaga

SEQ ID NO: 87169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacacaaagagaaagctgtt

SEQ ID NO: 87170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaaaccaagtggtgggga

SEQ ID NO: 87171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgaaaccaagtggtgggg

SEQ ID NO: 87172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtttcatgaaaccaagtggt

SEQ ID NO: 87173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcacatatagggatacct

SEQ ID NO: 87174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaggcacatatagggatac

SEQ ID NO: 87175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaggcacatatagggata

SEQ ID NO: 87176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttctgaggcacatatag

SEQ ID NO: 87177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtttctgaggcacatata

SEQ ID NO: 87178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtttctgaggcacatat

SEQ ID NO: 87179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttttgtgtttctgaggca

SEQ ID NO: 87180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtgttttgtgtttctgag

SEQ ID NO: 87181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgtgttttgtgtttctga

SEQ ID NO: 87182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgtgttttgtgtttctg

SEQ ID NO: 87183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taattttgttgtgttttgtg

SEQ ID NO: 87184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatcagcagagatgaaggg

SEQ ID NO: 87185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaaatcagcagagatgaa

SEQ ID NO: 87186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattcctaaaatcagcagag

SEQ ID NO: 87187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaattcctaaaatcagcag

SEQ ID NO: 87188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaattcctaaaatcagca

SEQ ID NO: 87189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatttctgaattcctaaaat

SEQ ID NO: 87190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatttctgaattcctaaaa

SEQ ID NO: 87191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaatttctgaattcctaa

SEQ ID NO: 87192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atattcttaaatttctgaat

SEQ ID NO: 87193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatattcttaaatttctga

SEQ ID NO: 87194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcatattcttaaatttctg

SEQ ID NO: 87195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccaaatcaaaacttctcat

SEQ ID NO: 87196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccccaaatcaaaacttctca

SEQ ID NO: 87197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccccaaatcaaaacttct

SEQ ID NO: 87198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcttccccaaatcaaaact

SEQ ID NO: 87199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcctcttccccaaatcaa

SEQ ID NO: 87200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcatactaattcctcttcc

SEQ ID NO: 87201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtatacccctatgcatac

SEQ ID NO: 87202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaagtatacccctatgca

SEQ ID NO: 87203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgaattactaaagtatacc

SEQ ID NO: 87204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attagtgaattactaaagta

SEQ ID NO: 87205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattagtgaattactaaagt

SEQ ID NO: 87206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaatttcattagtgaatt

SEQ ID NO: 87207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaaatttcattagtgaat

SEQ ID NO: 87208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcatttacaaaatttcatta

SEQ ID NO: 87209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataaataataggaagtgat

SEQ ID NO: 87210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggataatagtgggcatagtt

SEQ ID NO: 87211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgtgtctaggataatagt

SEQ ID NO: 87212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattcaatgtgtctaggata

SEQ ID NO: 87213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagctcaattcaatgtgtc

SEQ ID NO: 87214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagagctcaattcaatgtg

SEQ ID NO: 87215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagacaaaattctaagagct

SEQ ID NO: 87216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagacaaaattctaagagc

SEQ ID NO: 87217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttacagacaaaattctaag

SEQ ID NO: 87218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttacagacaaaattctaa

SEQ ID NO: 87219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatttacagacaaaattct

SEQ ID NO: 87220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attcttatttacagacaaaa

SEQ ID NO: 87221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taattcttatttacagacaa

SEQ ID NO: 87222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaaatatagttctaattc

SEQ ID NO: 87223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtgacctcataaaatat

SEQ ID NO: 87224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttaaaagtgacctcataa

SEQ ID NO: 87225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgactaagttaaaagtgac

SEQ ID NO: 87226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaacatggaatcattgatg

SEQ ID NO: 87227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaacatggaatcattgat

SEQ ID NO: 87228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagagaatgtgtttacaaa

SEQ ID NO: 87229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgatcaccagtgggcaaga

SEQ ID NO: 87230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctggtgatcaccagtgggc

SEQ ID NO: 87231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctggtgatcaccagtggg

SEQ ID NO: 87232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctggtgatcaccagtgg

SEQ ID NO: 87233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccctggtgatcaccagtg

SEQ ID NO: 87234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttttccctggtgatcacc

SEQ ID NO: 87235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccttttccctggtgatcac

SEQ ID NO: 87236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccttttccctggtgatca

SEQ ID NO: 87237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgccttttccctggtgatc

SEQ ID NO: 87238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataaccttttgccttttcc

SEQ ID NO: 87239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataaccttttgccttttc

SEQ ID NO: 87240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaataaccttttgcctttt

SEQ ID NO: 87241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agctttgaataaccttttgc

SEQ ID NO: 87242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagctttgaataaccttttg

SEQ ID NO: 87243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagctttgaataacctttt

SEQ ID NO: 87244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagctttgaataaccttt

SEQ ID NO: 87245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgagctttgaataacctt

SEQ ID NO: 87246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttgagctttgaataacc

SEQ ID NO: 87247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgttctttttgagcttt

SEQ ID NO: 87248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaatgttctttttgagctt

SEQ ID NO: 87249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtaatacatatacttaaa

SEQ ID NO: 87250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agccgctgatgtaatacata

SEQ ID NO: 87251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacacatgcaactaagccg

SEQ ID NO: 87252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatacacatgcaactaagcc

SEQ ID NO: 87253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatacacatgcaactaagc

SEQ ID NO: 87254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acattttaatacacatgcaa

SEQ ID NO: 87255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacattttaatacacatgca

SEQ ID NO: 87256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccttcacattttaatacac

SEQ ID NO: 87257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatatactgcccttcaca

SEQ ID NO: 87258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaataatatactgccctt

SEQ ID NO: 87259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattaataatatactgccct

SEQ ID NO: 87260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgattaataatatactgccc

SEQ ID NO: 87261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgattaataatatactgcc

SEQ ID NO: 87262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaccatcttttgattaata

SEQ ID NO: 87263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttataaccatcttttgatt

SEQ ID NO: 87264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agttataaccatcttttgat

SEQ ID NO: 87265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagttataaccatcttttg

SEQ ID NO: 87266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcttagttataaccatctt

SEQ ID NO: 87267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actcttagttataaccatct

SEQ ID NO: 87268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactcttagttataaccat

SEQ ID NO: 87269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttactcttagttataacca

SEQ ID NO: 87270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcttactcttagttataa

SEQ ID NO: 87271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtttcttactcttagtta

SEQ ID NO: 87272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaataattcctgtttcttac

SEQ ID NO: 87273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagttgaaataattcctgtt

SEQ ID NO: 87274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagttgaaataattcctgt

SEQ ID NO: 87275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgtagttgaaataatt

SEQ ID NO: 87276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttgtagttgaaataat

SEQ ID NO: 87277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatatttgtagttgaaataa

SEQ ID NO: 87278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctttatatttgtagttgaa

SEQ ID NO: 87279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaaaagtcaccgtcaaa

SEQ ID NO: 87280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatattataaaaaaagtc

SEQ ID NO: 87281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatattataaaaaaagt

SEQ ID NO: 87282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatattataaaaaaag

SEQ ID NO: 87283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataatgttttaaaaatat

SEQ ID NO: 87284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaaataatgttttaaaaa

SEQ ID NO: 87285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaaataatgttttaaaa

SEQ ID NO: 87286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaaaataatgttttaaa

SEQ ID NO: 87287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttaaaataatgttttaa

SEQ ID NO: 87288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttaaaataatgtttta

SEQ ID NO: 87289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgttaaaataatgtttt

SEQ ID NO: 87290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttgttaaaataatgttt

SEQ ID NO: 87291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaagctttttttgttaaa

SEQ ID NO: 87292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaaaaagctttttttgtta

SEQ ID NO: 87293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcactctgaaaaagcttttt

SEQ ID NO: 87294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcactctgaaaaagctttt

SEQ ID NO: 87295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttagcactctgaaaaagctt

SEQ ID NO: 87296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcttagcactctgaaaaag

SEQ ID NO: 87297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatagagagcaggcaaat

SEQ ID NO: 87298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatatagagagcaggcaaa

SEQ ID NO: 87299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcttatatatagagagcag

SEQ ID NO: 87300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtgcgtctgtgcttata

SEQ ID NO: 87301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaatatgtgtgtatgtct

SEQ ID NO: 87302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggaaatatgtgtgtatgtc

SEQ ID NO: 87303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttaggaaatatgtgtgtat

SEQ ID NO: 87304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgtctacttaggaaatat

SEQ ID NO: 87305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtgtctacttaggaaata

SEQ ID NO: 87306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatatgaatgtcttaagtgt

SEQ ID NO: 87307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agatatgaatgtcttaagtg

SEQ ID NO: 87308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacttagatatgaatgtct

SEQ ID NO: 87309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacttagatatgaatgtc

SEQ ID NO: 87310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacttagatatgaatgt

SEQ ID NO: 87311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaacttagatatgaatg

SEQ ID NO: 87312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaacttagatatgaat

SEQ ID NO: 87313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaacttagatatgaa

SEQ ID NO: 87314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcgccaaatcagattttt

SEQ ID NO: 87315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtcgccaaatcagatttt

SEQ ID NO: 87316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtcgccaaatcagattt

SEQ ID NO: 87317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagcctttgtgtcgccaaa

SEQ ID NO: 87318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaagcctttgtgtcgccaa

SEQ ID NO: 87319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttggaagcctttgtgtcg

SEQ ID NO: 87320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccttggaagcctttgtgtc

SEQ ID NO: 87321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcccttggaagcctttgtg

SEQ ID NO: 87322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattcttcccttggaagcct

SEQ ID NO: 87323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaattcttcccttggaag

SEQ ID NO: 87324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaattcttcccttggaa

SEQ ID NO: 87325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaaattcttcccttgga

SEQ ID NO: 87326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagatattttgttaaattct

SEQ ID NO: 87327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagatattttgttaaattc

SEQ ID NO: 87328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagacttcaagatattttgt

SEQ ID NO: 87329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagacttcaagatattttg

SEQ ID NO: 87330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgcttcaagacttcaagat

SEQ ID NO: 87331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgcttcaagacttcaaga

SEQ ID NO: 87332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgcttcaagacttcaag

SEQ ID NO: 87333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatgcttcaagacttcaa

SEQ ID NO: 87334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcttttcatgcttcaagac

SEQ ID NO: 87335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcttttcatgcttcaaga

SEQ ID NO: 87336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggcttttcatgcttcaag

SEQ ID NO: 87337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaggcttttcatgcttcaa

SEQ ID NO: 87338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaggcttttcatgcttca

SEQ ID NO: 87339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttaggcttttcatgctt

SEQ ID NO: 87340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttttaggcttttcatgct

SEQ ID NO: 87341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctttttaggcttttcatg

SEQ ID NO: 87342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttctttttaggcttttc

SEQ ID NO: 87343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattattcttctttttaggc

SEQ ID NO: 87344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattattcttctttttagg

SEQ ID NO: 87345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtattattcttctttttag

SEQ ID NO: 87346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgtattattcttctttt

SEQ ID NO: 87347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgtattattcttcttt

SEQ ID NO: 87348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttgtattattcttctt

SEQ ID NO: 87349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttttgtattattcttct

SEQ ID NO: 87350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtgtgggtttttgttttg

SEQ ID NO: 87351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accaccctgatgtgtgggtt

SEQ ID NO: 87352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccaccctgatgtgtgggt

SEQ ID NO: 87353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttcaccaccctgatgtgt

SEQ ID NO: 87354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatttcaccaccctgatgt

SEQ ID NO: 87355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatttcaccaccctgatg

SEQ ID NO: 87356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcatttcaccaccctgat

SEQ ID NO: 87357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actttctcatttcaccaccc

SEQ ID NO: 87358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgactttctcatttcaccac

SEQ ID NO: 87359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgactttctcatttcacca

SEQ ID NO: 87360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaggaaaatgtttctgact

SEQ ID NO: 87361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaggaaaatgtttctgac

SEQ ID NO: 87362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataaggaaaatgtttctga

SEQ ID NO: 87363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataaactttataaggaaaat

SEQ ID NO: 87364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtggttgataaactttata

SEQ ID NO: 87365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataaaccataaagtaattg

SEQ ID NO: 87366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataaaccataaagtaatt

SEQ ID NO: 87367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatataaaccataaagtaat

SEQ ID NO: 87368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataattttatataaaccata

SEQ ID NO: 87369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgcagttcataattttat

SEQ ID NO: 87370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgataagttgtatgcagtt

SEQ ID NO: 87371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgataagttgtatgcagt

SEQ ID NO: 87372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgataagttgtatgcag

SEQ ID NO: 87373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcatgataagttgtatgca

SEQ ID NO: 87374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcatgataagttgtatgc

SEQ ID NO: 87375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caggaagcaattttttcatg

SEQ ID NO: 87376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agttgcaggaagcaattttt

SEQ ID NO: 87377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctcagttgcaggaagcaa

SEQ ID NO: 87378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcagctcagttgcaggaag

SEQ ID NO: 87379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattcctcagctcagttgca

SEQ ID NO: 87380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acacatatcatccctaaatt

SEQ ID NO: 87381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacacatatcatccctaaat

SEQ ID NO: 87382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgacacatatcatccctaaa

SEQ ID NO: 87383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctttgacacatatcatcc

SEQ ID NO: 87384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctttgacacatatcatc

SEQ ID NO: 87385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctttgacacatatcat

SEQ ID NO: 87386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaagaaacatgttttcac

SEQ ID NO: 87387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaaagaaacatgttttca

SEQ ID NO: 87388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgaaaaagaaacatgttt

SEQ ID NO: 87389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgaaaaagaaacatgtt

SEQ ID NO: 87390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcttgaaaaagaaacatgt

SEQ ID NO: 87391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcttgaaaaagaaacatg

SEQ ID NO: 87392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacatgacccacatctttt

SEQ ID NO: 87393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accacatgacccacatcttt

SEQ ID NO: 87394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatagaaccttaccacatg

SEQ ID NO: 87395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaagagagccatgaagata

SEQ ID NO: 87396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaagagagccatgaagat

SEQ ID NO: 87397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggcaagagagccatgaaga

SEQ ID NO: 87398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggcaagagagccatgaag

SEQ ID NO: 87399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatacatcagtcttttgg

SEQ ID NO: 87400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataaagtgattaaatatac

SEQ ID NO: 87401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatcacatccattagata

SEQ ID NO: 87402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaatcacatccattagat

SEQ ID NO: 87403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaaatcacatccattaga

SEQ ID NO: 87404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgactttagaaatcacatcc

SEQ ID NO: 87405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgtgactttagaaatcac

SEQ ID NO: 87406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggctaactgtgactttag

SEQ ID NO: 87407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaatggctaactgtgactt

SEQ ID NO: 87408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaatggctaactgtgact

SEQ ID NO: 87409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctaatggctaactgtgac

SEQ ID NO: 87410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaccagagcaagagctttcc

SEQ ID NO: 87411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctgaaccagagcaagagc

SEQ ID NO: 87412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaccacaaagtcaggaaat

SEQ ID NO: 87413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaaaccacaaagtcaggaa

SEQ ID NO: 87414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgaaaccacaaagtcagg

SEQ ID NO: 87415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctgaaaccacaaagtcag

SEQ ID NO: 87416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttctctgaaaccacaaagt

SEQ ID NO: 87417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcttctctgaaaccacaaa

SEQ ID NO: 87418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caccagctctgcttctctga

SEQ ID NO: 87419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccaccagctctgcttctct

SEQ ID NO: 87420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgaatccagccagggaatt

SEQ ID NO: 87421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccatagcaaagactgatga

SEQ ID NO: 87422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtccatagcaaagactgatg

SEQ ID NO: 87423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgtccatagcaaagactga

SEQ ID NO: 87424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttgtccatagcaaagact

SEQ ID NO: 87425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattctcttgtccatagcaa

SEQ ID NO: 87426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtattctcttgtccatag

SEQ ID NO: 87427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgtattctcttgtccata

SEQ ID NO: 87428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatggtcttactgtattctc

SEQ ID NO: 87429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatggtcttactgtattct

SEQ ID NO: 87430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgacttggatggtcttact

SEQ ID NO: 87431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccaacccccaagactaatg

SEQ ID NO: 87432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgtagtgaatctacccaa

SEQ ID NO: 87433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatgtagtgaatctaccca

SEQ ID NO: 87434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagacttggatgtagtgaat

SEQ ID NO: 87435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaagacttggatgtagtga

SEQ ID NO: 87436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctctaaagacttggatgta

SEQ ID NO: 87437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctctaaagacttggatgt

SEQ ID NO: 87438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccatatgggcacttggctc

SEQ ID NO: 87439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttagccatatgggcact

SEQ ID NO: 87440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtaattaaagttagccat

SEQ ID NO: 87441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagtaattaaagttagcc

SEQ ID NO: 87442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctatagtaattaaagtta

SEQ ID NO: 87443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggaaaaaaaatctgttcta

SEQ ID NO: 87444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggaaaaaaaatctgttct

SEQ ID NO: 87445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcaagaagggtaagaattt

SEQ ID NO: 87446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatctaatcaagaagggta

SEQ ID NO: 87447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaatctaatcaagaagggt

SEQ ID NO: 87448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttccaatctaatcaagaag

SEQ ID NO: 87449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttccaatctaatcaagaa

SEQ ID NO: 87450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cataatgagatttgtttcca

SEQ ID NO: 87451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaactccataatgagatttg

SEQ ID NO: 87452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaactccataatgagattt

SEQ ID NO: 87453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaaactccataatgaga

SEQ ID NO: 87454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atggtaattatttaaaactc

SEQ ID NO: 87455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catggtaattatttaaaact

SEQ ID NO: 87456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgatgatgagcttcatggt

SEQ ID NO: 87457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatggtatcaggttgatgat

SEQ ID NO: 87458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agatggtatcaggttgatga

SEQ ID NO: 87459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagatggtatcaggttgat

SEQ ID NO: 87460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacataaacatattcttaga

SEQ ID NO: 87461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacataaacatattcttag

SEQ ID NO: 87462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcacataaacatattctta

SEQ ID NO: 87463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgcacataaacatattc

SEQ ID NO: 87464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattattttgcacataaaca

SEQ ID NO: 87465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtatcattgcattatttt

SEQ ID NO: 87466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtatcattgcattattt

SEQ ID NO: 87467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaagtatcattgcattatt

SEQ ID NO: 87468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaagtatcattgcattat

SEQ ID NO: 87469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaagtatcattgcatta

SEQ ID NO: 87470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttttcaagtatcattg

SEQ ID NO: 87471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattttttcaagtatcatt

SEQ ID NO: 87472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttaaattttttcaagta

SEQ ID NO: 87473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatttaaattttttcaagt

SEQ ID NO: 87474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacttgaatttaaatttttt

SEQ ID NO: 87475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caacagtaaacatatcacac

SEQ ID NO: 87476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaacagtaaacatatcaca

SEQ ID NO: 87477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcttacaacagtaaacat

SEQ ID NO: 87478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtatcttacaacagtaaa

SEQ ID NO: 87479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtatcttacaacagtaa

SEQ ID NO: 87480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgtatcttacaacagta

SEQ ID NO: 87481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgtatcttacaacagt

SEQ ID NO: 87482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttactgtatcttacaacag

SEQ ID NO: 87483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattttttactgtatcttac

SEQ ID NO: 87484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acattttttactgtatctta

SEQ ID NO: 87485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttacattttttactgtat

SEQ ID NO: 87486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctcacttacattttttact

SEQ ID NO: 87487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagctcacttacatttttta

SEQ ID NO: 87488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatatattctagctcactt

SEQ ID NO: 87489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatatattctagctcact

SEQ ID NO: 87490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgtgatatattctagctc

SEQ ID NO: 87491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaacgccatagaatgaag

SEQ ID NO: 87492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaaacgccatagaatgaa

SEQ ID NO: 87493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagaaacgccatagaatg

SEQ ID NO: 87494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaagaaacgccatagaat

SEQ ID NO: 87495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacgtgtttcttaagaaacg

SEQ ID NO: 87496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattgtacgtgtttcttaa

SEQ ID NO: 87497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacattgtacgtgtttctta

SEQ ID NO: 87498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacattgtacgtgtttctt

SEQ ID NO: 87499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttaacattgtacgtgttt

SEQ ID NO: 87500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatgtcaagtactatttta

SEQ ID NO: 87501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagatgtcaagtactatttt

SEQ ID NO: 87502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagatgtcaagtactattt

SEQ ID NO: 87503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagatgtcaagtactatt

SEQ ID NO: 87504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagatgtcaagtactat

SEQ ID NO: 87505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagatgtcaagtacta

SEQ ID NO: 87506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagatgtcaagtact

SEQ ID NO: 87507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttttgagatgtcaagt

SEQ ID NO: 87508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttttttgagatgtcaag

SEQ ID NO: 87509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggcttattttttttgagat

SEQ ID NO: 87510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggcttattttttttgaga

SEQ ID NO: 87511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgggtttagggcttattttt

SEQ ID NO: 87512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgggtttagggcttatttt

SEQ ID NO: 87513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacgggtttagggcttattt

SEQ ID NO: 87514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccattttacgggtttaggg

SEQ ID NO: 87515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccccattttacgggtttag

SEQ ID NO: 87516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccccattttacgggttta

SEQ ID NO: 87517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctccccattttacgggttt

SEQ ID NO: 87518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctccccattttacgggtt

SEQ ID NO: 87519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctccccattttacgggt

SEQ ID NO: 87520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagttttttctccccatttt

SEQ ID NO: 87521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagttttttctccccattt

SEQ ID NO: 87522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatagttttttctccccatt

SEQ ID NO: 87523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaatataccaactttatag

SEQ ID NO: 87524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accaatataccaactttata

SEQ ID NO: 87525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataggcacacttaccaat

SEQ ID NO: 87526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acattataataggcacactt

SEQ ID NO: 87527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcattcacattataataggc

SEQ ID NO: 87528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtcattcacattataata

SEQ ID NO: 87529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgtcattcacattataat

SEQ ID NO: 87530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtagggccgtgtaaatc

SEQ ID NO: 87531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaaaagtagggccgtgtaa

SEQ ID NO: 87532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaggctgttaaaagtaggg

SEQ ID NO: 87533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcaggctgttaaaagtag

SEQ ID NO: 87534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtcaggctgttaaaagta

SEQ ID NO: 87535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtcaggctgttaaaagt

SEQ ID NO: 87536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaattttctgtcaggctgt

SEQ ID NO: 87537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgtaaattttctgtcaggc

SEQ ID NO: 87538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctactgtaaattttctgtc

SEQ ID NO: 87539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctactgtaaattttctgt

SEQ ID NO: 87540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggggaatcatccataagt

SEQ ID NO: 87541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaggggaatcatccataag

SEQ ID NO: 87542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaggggaatcatccataa

SEQ ID NO: 87543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatagaacagtctttaaagg

SEQ ID NO: 87544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaatagaacagtctttaa

SEQ ID NO: 87545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaatagaacagtcttta

SEQ ID NO: 87546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattgaatagaacagtcttt

SEQ ID NO: 87547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagcaaaggaatgcatacaa

SEQ ID NO: 87548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagcaaaggaatgcataca

SEQ ID NO: 87549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcttgtagcaaaggaatgc

SEQ ID NO: 87550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtcttgtagcaaaggaat

SEQ ID NO: 87551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggtcttgtagcaaaggaa

SEQ ID NO: 87552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctggtcttgtagcaaag

SEQ ID NO: 87553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctggtcttgtagcaaa

SEQ ID NO: 87554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttctggtcttgtagcaa

SEQ ID NO: 87555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataatgctttatttctggt

SEQ ID NO: 87556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatcacattgtataatgctt

SEQ ID NO: 87557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatcacattgtataatgct

SEQ ID NO: 87558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttagatcacattgtataat

SEQ ID NO: 87559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatttagatcacattgtat

SEQ ID NO: 87560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttatttagatcacattgta

SEQ ID NO: 87561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acttgttatttagatcacat

SEQ ID NO: 87562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacttgttatttagatcaca

SEQ ID NO: 87563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacttgttatttagatcac

SEQ ID NO: 87564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacttgttatttagatca

SEQ ID NO: 87565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaacttgttatttagatc

SEQ ID NO: 87566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttttaacttgttattta

SEQ ID NO: 87567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctttttaacttgttattt

SEQ ID NO: 87568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatctttttaacttgttatt

SEQ ID NO: 87569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatggtgttttatcttttt

SEQ ID NO: 87570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accatggtgttttatctttt

SEQ ID NO: 87571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttaccatggtgttttatc

SEQ ID NO: 87572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaccatcattaatttacca

SEQ ID NO: 87573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaccatcattaatttacc

SEQ ID NO: 87574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttatcaccatcattaat

SEQ ID NO: 87575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacatttatcaccatcatt

SEQ ID NO: 87576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attacatttatcaccatcat

SEQ ID NO: 87577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taggcttattacatttatca

SEQ ID NO: 87578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtaggcttattacattta

SEQ ID NO: 87579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtaggcttattacattt

SEQ ID NO: 87580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtaggcttattacatt

SEQ ID NO: 87581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttattgtaggcttattacat

SEQ ID NO: 87582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttttattgtaggcttatta

SEQ ID NO: 87583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagtctgcttttattgtagg

SEQ ID NO: 87584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcagtctgcttttattgt

SEQ ID NO: 87585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgcagtctgcttttattg

SEQ ID NO: 87586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcttactgcagtctgctt

SEQ ID NO: 87587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtcttactgcagtctgct

SEQ ID NO: 87588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttcagtcttactgcagtc

SEQ ID NO: 87589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtttcagtcttactgcagt

SEQ ID NO: 87590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagtttcagtcttactgca

SEQ ID NO: 87591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttagtttcagtcttactgc

SEQ ID NO: 87592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttcttagtttcagtctta

SEQ ID NO: 87593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttcttagtttcagtctt

SEQ ID NO: 87594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttggtttcttagtttcagt

SEQ ID NO: 87595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttggtttcttagtttcag

SEQ ID NO: 87596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgccttatttggtttctta

SEQ ID NO: 87597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaatgccttatttggtttc

SEQ ID NO: 87598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctaatgccttatttggttt

SEQ ID NO: 87599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtacagaatgtaaggtcct

SEQ ID NO: 87600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtacagaatgtaaggtcc

SEQ ID NO: 87601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacttcagtacagaatgtaa

SEQ ID NO: 87602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatacttcagtacagaatgt

SEQ ID NO: 87603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatacttcagtacagaatg

SEQ ID NO: 87604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataatatttctatacttca

SEQ ID NO: 87605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaataatatttctatact

SEQ ID NO: 87606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctaaataatatttctatac

SEQ ID NO: 87607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctaaataatatttctata

SEQ ID NO: 87608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcctaaataatatttct

SEQ ID NO: 87609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctttcctaaataatatttc

SEQ ID NO: 87610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagcttgctttcctaaataa

SEQ ID NO: 87611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgattgaagcttgctttcct

SEQ ID NO: 87612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgattgaagcttgctttcc

SEQ ID NO: 87613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgattgaagcttgctttc

SEQ ID NO: 87614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttttgtgattgaagctt

SEQ ID NO: 87615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgattgatgttttgtgatt

SEQ ID NO: 87616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaatgattgatgttttgt

SEQ ID NO: 87617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaatgattgatgttttg

SEQ ID NO: 87618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattaatgattgatgtttt

SEQ ID NO: 87619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaaggtgcatatacgaaa

SEQ ID NO: 87620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagtctaatgaaggtgcat

SEQ ID NO: 87621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaagagtctaatgaaggt

SEQ ID NO: 87622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcagttcattaagagtcta

SEQ ID NO: 87623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatcagttcattaagagtct

SEQ ID NO: 87624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatcagttcattaagagtc

SEQ ID NO: 87625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatcagttcattaagagt

SEQ ID NO: 87626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagaaaacatttttaatcag

SEQ ID NO: 87627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acccattggagaaaacattt

SEQ ID NO: 87628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaaaaattaacccattgg

SEQ ID NO: 87629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caactaagaaaaaattaacc

SEQ ID NO: 87630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcaactaagaaaaaatta

SEQ ID NO: 87631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcagtatatagaagaatat

SEQ ID NO: 87632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcagtatatagaagaata

SEQ ID NO: 87633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtaggaaaagtatcttg

SEQ ID NO: 87634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctgtgtgtaggaaaagta

SEQ ID NO: 87635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgctgtgtgtaggaaaagt

SEQ ID NO: 87636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttatgctgtgtgtaggaaaa

SEQ ID NO: 87637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttatgctgtgtgtaggaaa

SEQ ID NO: 87638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatatcttcttatgctgtgt

SEQ ID NO: 87639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgtggaagtctcaatatct

SEQ ID NO: 87640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attaacgtggaagtctcaat

SEQ ID NO: 87641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattaacgtggaagtctcaa

SEQ ID NO: 87642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttgattaacgtggaagt

SEQ ID NO: 87643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtttgattaacgtggaag

SEQ ID NO: 87644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtttgattaacgtggaa

SEQ ID NO: 87645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagtttgattaacgtgga

SEQ ID NO: 87646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttcagtttgattaacgt

SEQ ID NO: 87647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acttttcagtttgattaacg

SEQ ID NO: 87648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttacttttcagtttgatt

SEQ ID NO: 87649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcttacttttcagtttgat

SEQ ID NO: 87650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtcttacttttcagttt

SEQ ID NO: 87651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaattccttgtcttactttt

SEQ ID NO: 87652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaattccttgtcttacttt

SEQ ID NO: 87653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttggaattccttgtctta

SEQ ID NO: 87654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatttggaattccttgtct

SEQ ID NO: 87655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaataggctctgatttggaa

SEQ ID NO: 87656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaataggctctgatttgg

SEQ ID NO: 87657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atagttctaaaataggctct

SEQ ID NO: 87658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgctcatagttctaaaat

SEQ ID NO: 87659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttgaatgctcatagttct

SEQ ID NO: 87660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttgaatgctcatagttc

SEQ ID NO: 87661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagttgaatgctcatagtt

SEQ ID NO: 87662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagacccgttttcagttgaa

SEQ ID NO: 87663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggcaacagaatggagcag

SEQ ID NO: 87664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggtggcaacagaatggag

SEQ ID NO: 87665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaattgttggtggcaacag

SEQ ID NO: 87666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacaaaaatgataccaatta

SEQ ID NO: 87667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcacaaaaatgataccaatt

SEQ ID NO: 87668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttgcacaaaaatgatacc

SEQ ID NO: 87669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaaggcacatctcacttgc

SEQ ID NO: 87670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaagcactaacaaggcaca

SEQ ID NO: 87671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagttaaaaagcactaacaa

SEQ ID NO: 87672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacactcaagttaaaaagc

SEQ ID NO: 87673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaacactcaagttaaaaag

SEQ ID NO: 87674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacaacttcaaacactcaag

SEQ ID NO: 87675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaacaacttcaaacactcaa

SEQ ID NO: 87676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgaacaacttcaaacact

SEQ ID NO: 87677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttgaacaacttcaaac

SEQ ID NO: 87678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatttgaacaacttcaaa

SEQ ID NO: 87679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaaaacagtttattattt

SEQ ID NO: 87680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagaaaacagtttattatt

SEQ ID NO: 87681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttagagaaaacagtttat

SEQ ID NO: 87682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtttagagaaaacagttta

SEQ ID NO: 87683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcttggtttagagaaaac

SEQ ID NO: 87684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcttggtttagagaaaa

SEQ ID NO: 87685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatcttggtttagagaaa

SEQ ID NO: 87686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaatcttggtttagagaa

SEQ ID NO: 87687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaacttttaaatcttggttt

SEQ ID NO: 87688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaacagatacaatg

SEQ ID NO: 87689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataagaaagaaattaaaaaa

SEQ ID NO: 87690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataagaaagaaattaaaaa

SEQ ID NO: 87691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataagaaagaaattaaaa

SEQ ID NO: 87692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatgttttaataagaaaga

SEQ ID NO: 87693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatgttttaataagaaag

SEQ ID NO: 87694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaagaaatttgtgatgttt

SEQ ID NO: 87695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaagaaatttgtgatgtt

SEQ ID NO: 87696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaaagaaatttgtgatgt

SEQ ID NO: 87697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaaagaaatttgtgatg

SEQ ID NO: 87698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcaaaagaaatttgtgat

SEQ ID NO: 87699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcaaaagaaatttgtga

SEQ ID NO: 87700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaccacgcccagaaagca

SEQ ID NO: 87701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagacattagccaccacgcc

SEQ ID NO: 87702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacagacattagccac

SEQ ID NO: 87703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctgggattacag

SEQ ID NO: 87704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggcctcccaaagtgctggga

SEQ ID NO: 87705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cggcctcccaaagtgctggg

SEQ ID NO: 87706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccacttcggcctcccaaag

SEQ ID NO: 87707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagtgatctgcccacttcgg

SEQ ID NO: 87708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcaagtgatctgcccac

SEQ ID NO: 87709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctcaagtgatctgcc

SEQ ID NO: 87710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcctgacctcaagtgat

SEQ ID NO: 87711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactcctgacctcaagtga

SEQ ID NO: 87712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacttgaactcctgacctca

SEQ ID NO: 87713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcaggctggacttgaactc

SEQ ID NO: 87714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcatgttggtcaggctgga

SEQ ID NO: 87715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcatgttggtcaggctgg

SEQ ID NO: 87716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagggaaggggtttcatcat

SEQ ID NO: 87717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagggaaggggtttcatca

SEQ ID NO: 87718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagggaaggggtttcatc

SEQ ID NO: 87719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaagggaaggggtttcat

SEQ ID NO: 87720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttgaagggaaggggt

SEQ ID NO: 87721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttgaagggaagggg

SEQ ID NO: 87722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttgaagggaaggg

SEQ ID NO: 87723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatttttgaagggaagg

SEQ ID NO: 87724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttttgtatttttgaaggga

SEQ ID NO: 87725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actatttttgtatttttgaa

SEQ ID NO: 87726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaacagggactcactattt

SEQ ID NO: 87727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaacagggactcactatt

SEQ ID NO: 87728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaacagggactcactat

SEQ ID NO: 87729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggaaacagggactcacta

SEQ ID NO: 87730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttggaaacagggactcact

SEQ ID NO: 87731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttggaaacagggactcac

SEQ ID NO: 87732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttggaaacagggactca

SEQ ID NO: 87733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttggaaacagggactc

SEQ ID NO: 87734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttggaaacagggact

SEQ ID NO: 87735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttggaaacagggac

SEQ ID NO: 87736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttggaaacaggga

SEQ ID NO: 87737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttggaaacaggg

SEQ ID NO: 87738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttggaaacagg

SEQ ID NO: 87739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttttggaaacag

SEQ ID NO: 87740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttttttttttggaaac

SEQ ID NO: 87741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttttttttttttttggaa

SEQ ID NO: 87742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttttttttttttttgga

SEQ ID NO: 87743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcttttttttttttttgg

SEQ ID NO: 87744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctcttttttttttttttg

SEQ ID NO: 87745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctctttttttttttttt

SEQ ID NO: 87746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttctcttttttttttttt

SEQ ID NO: 87747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttctcttttttttttt

SEQ ID NO: 87748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagcacagctcttttttctc

SEQ ID NO: 87749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagcacagctcttttttct

SEQ ID NO: 87750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagcacagctcttttttc

SEQ ID NO: 87751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtagcacagctctttttt

SEQ ID NO: 87752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtagcacagctcttttt

SEQ ID NO: 87753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtagcacagctctttt

SEQ ID NO: 87754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggcatttttttgtagcaca

SEQ ID NO: 87755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggcatttttttgtagcac

SEQ ID NO: 87756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggcatttttttgtagca

SEQ ID NO: 87757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgttttaaggcatttttt

SEQ ID NO: 87758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcaactaaatgttttaagg

SEQ ID NO: 87759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgttaggcaactaaatgtt

SEQ ID NO: 87760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtgttaggcaactaaatgt

SEQ ID NO: 87761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttggtgttaggcaactaaa

SEQ ID NO: 87762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcttggtgttaggcaactaa

SEQ ID NO: 87763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacttgcttggtgttaggc

SEQ ID NO: 87764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcaaacttgcttggtgtta

SEQ ID NO: 87765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcaaacttgcttggtgtt

SEQ ID NO: 87766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataatttattcaaacttgc

SEQ ID NO: 87767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgaatattacataattta

SEQ ID NO: 87768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgaatgaatattacataa

SEQ ID NO: 87769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcattgaatgaatattaca

SEQ ID NO: 87770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttcattgaatgaatattac

SEQ ID NO: 87771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttcattgaatgaatatt

SEQ ID NO: 87772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagacaaagggtctcttgtt

SEQ ID NO: 87773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcagacaaagggtctctt

SEQ ID NO: 87774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattgcagacaaagggtct

SEQ ID NO: 87775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctattgcagacaaagggtc

SEQ ID NO: 87776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaatttcctattgcagac

SEQ ID NO: 87777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcatgggaagattatcaaa

SEQ ID NO: 87778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcatgggaagattatcaa

SEQ ID NO: 87779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtcatgggaagattatca

SEQ ID NO: 87780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtcatgggaagattatc

SEQ ID NO: 87781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttagtcatgggaagattat

SEQ ID NO: 87782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttagtcatgggaagatta

SEQ ID NO: 87783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttagtcatgggaagatt

SEQ ID NO: 87784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttagtcatgggaagat

SEQ ID NO: 87785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatttttttttagtcatgg

SEQ ID NO: 87786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagattataattttttttta

SEQ ID NO: 87787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacatagtggggagctgtag

SEQ ID NO: 87788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtacatagtggggagctgt

SEQ ID NO: 87789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgtacatagtggggagc

SEQ ID NO: 87790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgacagaccaaagacatgac

SEQ ID NO: 87791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgacagaccaaagacatg

SEQ ID NO: 87792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatgacagaccaaagacat

SEQ ID NO: 87793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaaaccttctatgacaga

SEQ ID NO: 87794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcagcatcaggttagtaaaa

SEQ ID NO: 87795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaatagggaaacagaagag

SEQ ID NO: 87796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatgtagactgcaaatagg

SEQ ID NO: 87797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacgtagaataatgtagctg

SEQ ID NO: 87798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggaaattaaacgtagaata

SEQ ID NO: 87799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggaaattaaacgtagaat

SEQ ID NO: 87800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggggaaattaaacgtagaa

SEQ ID NO: 87801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctttggggaaattaaacg

SEQ ID NO: 87802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctgacctttggggaaatta

SEQ ID NO: 87803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctagctgacctttggggaa

SEQ ID NO: 87804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaggatgcagaaattatct

SEQ ID NO: 87805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agataaagggaacattatga

SEQ ID NO: 87806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagataaagggaacatta

SEQ ID NO: 87807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaactgttcagataaaggga

SEQ ID NO: 87808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaagcaagtaatcaggtga

SEQ ID NO: 87809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agccaaatattacaaagcaa

SEQ ID NO: 87810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atacaagaggtattgagcca

SEQ ID NO: 87811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catacaagaggtattgagcc

SEQ ID NO: 87812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatacaagaggtattgagc

SEQ ID NO: 87813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatacaagaggtattgag

SEQ ID NO: 87814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggaaggaaggaggcgaag

SEQ ID NO: 87815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagggaaggaaggaggcgaa

SEQ ID NO: 87816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttgagggaaggaaggag

SEQ ID NO: 87817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttgagggaaggaagga

SEQ ID NO: 87818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatttatatttgagggaagg

SEQ ID NO: 87819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgaagggttgaatttatat

SEQ ID NO: 87820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagatatgggagaaagagaa

SEQ ID NO: 87821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagcagactggagatatgg

SEQ ID NO: 87822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagctcaaagcagactgga

SEQ ID NO: 87823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctggcagctcaaagcagact

SEQ ID NO: 87824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggggactgctggcagctcaa

SEQ ID NO: 87825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggggactgctggcagctca

SEQ ID NO: 87826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagaagtaggataaaaatcc

SEQ ID NO: 87827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggagacaggcgtgatgaa

SEQ ID NO: 87828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttgaaggagacaggcgtga

SEQ ID NO: 87829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatctagttgaaggagaca

SEQ ID NO: 87830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaatctagttgaaggagac

SEQ ID NO: 87831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaagtttggaatctagttg

SEQ ID NO: 87832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctatgaagtttggaatcta

SEQ ID NO: 87833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtctatgaagtttggaat

SEQ ID NO: 87834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgtctatgaagtttggaa

SEQ ID NO: 87835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agacaaatttcctgtctatg

SEQ ID NO: 87836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgataatacatgcctaaga

SEQ ID NO: 87837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtgataatacatgcctaag

SEQ ID NO: 87838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccttggtgataatacatg

SEQ ID NO: 87839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgatgtgccagatatcat

SEQ ID NO: 87840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgatgtgccagatatca

SEQ ID NO: 87841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgatgtgccagatatc

SEQ ID NO: 87842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaattttatatgatgtgcc

SEQ ID NO: 87843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaattttatatgatgtgc

SEQ ID NO: 87844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaagcatttaacaatttt

SEQ ID NO: 87845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attcatcaagcatttaacaa

SEQ ID NO: 87846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattcatcaagcatttaaca

SEQ ID NO: 87847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accatcttcattcatcaagc

SEQ ID NO: 87848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccatcttcattcatcaag

SEQ ID NO: 87849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagaagtatttcaccatct

SEQ ID NO: 87850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttaggagaagtatttcac

SEQ ID NO: 87851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggttaggagaagtatttca

SEQ ID NO: 87852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgcttgggttaggagaa

SEQ ID NO: 87853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caagtgcttgggttaggaga

SEQ ID NO: 87854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaagtgcttgggttagga

SEQ ID NO: 87855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcaagtgcttgggttagg

SEQ ID NO: 87856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatagcgtgcttcttcaagt

SEQ ID NO: 87857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggcaatataattagatag

SEQ ID NO: 87858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgttaaaggcaatataatta

SEQ ID NO: 87859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtgacatctatgttaaag

SEQ ID NO: 87860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattagtgtgacatctatgt

SEQ ID NO: 87861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaattagtgtgacatctatg

SEQ ID NO: 87862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttaaattagtgtgacatc

SEQ ID NO: 87863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattgtcttaaattagtgt

SEQ ID NO: 87864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataataattaaaattgtct

SEQ ID NO: 87865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaataataattaaaattg

SEQ ID NO: 87866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaataataattaaaatt

SEQ ID NO: 87867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaaataataattaaaat

SEQ ID NO: 87868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaattttgttaaataata

SEQ ID NO: 87869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaaattttgttaaataat

SEQ ID NO: 87870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaatcttagaaaattttg

SEQ ID NO: 87871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacactgaaaaatcttaga

SEQ ID NO: 87872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaacactgaaaaatcttag

SEQ ID NO: 87873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggaacactgaaaaatctt

SEQ ID NO: 87874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagatgctcttggaacactg

SEQ ID NO: 87875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagatgctcttggaacact

SEQ ID NO: 87876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaatgtttgaagatgctct

SEQ ID NO: 87877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtaaatgtttgaagatgc

SEQ ID NO: 87878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggattattgtaaatgtttg

SEQ ID NO: 87879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgtaaaatcaatgatagtt

SEQ ID NO: 87880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgatgtaaaatcaatgatag

SEQ ID NO: 87881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgatgtaaaatcaatgata

SEQ ID NO: 87882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagatagcgtttctgatgta

SEQ ID NO: 87883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagtgccataaattaaaga

SEQ ID NO: 87884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaggagaaaaagagcaat

SEQ ID NO: 87885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaggagaaaaagagcaa

SEQ ID NO: 87886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgaggagaaaaagagca

SEQ ID NO: 87887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgaggagaaaaagagc

SEQ ID NO: 87888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaatgaggagaaaaagag

SEQ ID NO: 87889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaatgaggagaaaaaga

SEQ ID NO: 87890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttttaatgaggagaaa

SEQ ID NO: 87891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttttttaatgaggagaa

SEQ ID NO: 87892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttttttaatgaggaga

SEQ ID NO: 87893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatgttttaatttttttaat

SEQ ID NO: 87894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatgttttaatttttttaa

SEQ ID NO: 87895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaatgttttaattttttta

SEQ ID NO: 87896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaatgttttaattttttt

SEQ ID NO: 87897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttcaatgttttaatttt

SEQ ID NO: 87898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttcaatgttttaattt

SEQ ID NO: 87899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttttcaatgttttaatt

SEQ ID NO: 87900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttgtttttcaatgtttta

SEQ ID NO: 87901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cataaaaggatggaaattgc

SEQ ID NO: 87902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacatatcagcctccataaa

SEQ ID NO: 87903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacatatcagcctccataa

SEQ ID NO: 87904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcacatatcagcctccata

SEQ ID NO: 87905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcacatatcagcctccat

SEQ ID NO: 87906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgcacatatcagcctcca

SEQ ID NO: 87907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttttgcacatatcagc

SEQ ID NO: 87908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atattttttgcacatatcag

SEQ ID NO: 87909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatagcagaatccttatat

SEQ ID NO: 87910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatggggaaacaggttgta

SEQ ID NO: 87911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatgtcactaaaatggggaa

SEQ ID NO: 87912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgatgtcactaaaatgggga

SEQ ID NO: 87913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttcgatgtcactaaaat

SEQ ID NO: 87914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtatttcgatgtcact

SEQ ID NO: 87915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattgtatttcgatgtcac

SEQ ID NO: 87916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattgtatttcgatgtca

SEQ ID NO: 87917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaattgtatttcgatgtc

SEQ ID NO: 87918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttaaattgtatttcgat

SEQ ID NO: 87919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcagatagtgttgttttta

SEQ ID NO: 87920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacctaagcagatagtgttg

SEQ ID NO: 87921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaacctaagcagatagt

SEQ ID NO: 87922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaaacctaagcagatag

SEQ ID NO: 87923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taattaaacctaagcagata

SEQ ID NO: 87924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttaattaaacctaagcag

SEQ ID NO: 87925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaaaaaaaaagctacttt

SEQ ID NO: 87926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggctggggaaaaaaaaagc

SEQ ID NO: 87927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggctggggaaaaaaaaag

SEQ ID NO: 87928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttatggctggggaaaaaaa

SEQ ID NO: 87929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtttatggctggggaaaa

SEQ ID NO: 87930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgtttatggctggggaaa

SEQ ID NO: 87931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accttcctgtttatggctgg

SEQ ID NO: 87932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccttcctgtttatggctg

SEQ ID NO: 87933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccttcctgtttatggct

SEQ ID NO: 87934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaccttcctgtttatggc

SEQ ID NO: 87935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accaaacttttaaccttcct

SEQ ID NO: 87936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccatctgaccaaactttt

SEQ ID NO: 87937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catccatctgaccaaacttt

SEQ ID NO: 87938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatccatctgaccaaactt

SEQ ID NO: 87939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatccatctgaccaaact

SEQ ID NO: 87940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcccccttttcatccatctg

SEQ ID NO: 87941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtccaccatattgtcccc

SEQ ID NO: 87942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttggtgtccaccatattgt

SEQ ID NO: 87943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttggtgtccaccatattg

SEQ ID NO: 87944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagttggtgtccaccatatt

SEQ ID NO: 87945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactttagttggtgtccacc

SEQ ID NO: 87946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaactttagttggtgtccac

SEQ ID NO: 87947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaactttagttggtgtcca

SEQ ID NO: 87948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaattttaaactttagtt

SEQ ID NO: 87949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaatcccaaattagagaa

SEQ ID NO: 87950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtaatcccaaattagaga

SEQ ID NO: 87951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatttgtgtaatcccaaat

SEQ ID NO: 87952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggatttgtgtaatcccaaa

SEQ ID NO: 87953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggatttgtgtaatcccaa

SEQ ID NO: 87954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaactttgggatttgtgta

SEQ ID NO: 87955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaactttgggatttgtgt

SEQ ID NO: 87956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaacttaaaaactttggga

SEQ ID NO: 87957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtgaacttaaaaactttg

SEQ ID NO: 87958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctgtgaacttaaaaactt

SEQ ID NO: 87959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttctgctgtgaacttaaa

SEQ ID NO: 87960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttctgctgtgaacttaa

SEQ ID NO: 87961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagttctgctgtgaactta

SEQ ID NO: 87962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagttctgctgtgaactt

SEQ ID NO: 87963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtatttttaagttctgct

SEQ ID NO: 87964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgaacatgtcaaaatgtgc

SEQ ID NO: 87965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtactggtgaacatgtcaa

SEQ ID NO: 87966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtactggtgaacatgtca

SEQ ID NO: 87967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtgcttaagtactggtga

SEQ ID NO: 87968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggtgcttaagtactggtg

SEQ ID NO: 87969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggtgcttaagtactggt

SEQ ID NO: 87970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caattttaaggtgcttaagt

SEQ ID NO: 87971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaataaaatatctacaattt

SEQ ID NO: 87972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaataaaatatctacaatt

SEQ ID NO: 87973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatatgtttcaaataaaa

SEQ ID NO: 87974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatatatgtttcaaataaa

SEQ ID NO: 87975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccttaaatatatgtttcaa

SEQ ID NO: 87976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccttaaatatatgtttca

SEQ ID NO: 87977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaatttgtccttaaatata

SEQ ID NO: 87978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaatttgtccttaaatat

SEQ ID NO: 87979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaagatttggcaatttgtcc

SEQ ID NO: 87980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatgttcaaagatttggcaa

SEQ ID NO: 87981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttggatgttcaaagatttgg

SEQ ID NO: 87982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttggatgttcaaagatttg

SEQ ID NO: 87983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttggatgttcaaagattt

SEQ ID NO: 87984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcgctttgttggatgttca

SEQ ID NO: 87985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatcgctttgttggatgttc

SEQ ID NO: 87986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatacttgatcgctttgttg

SEQ ID NO: 87987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacaattaaatacttgatc

SEQ ID NO: 87988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaacaattaaatacttga

SEQ ID NO: 87989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaaacaattaaatacttg

SEQ ID NO: 87990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtttctaaaacaattaaat

SEQ ID NO: 87991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcctaggtttctaaaacaa

SEQ ID NO: 87992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatctgtgcctaggtttcta

SEQ ID NO: 87993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggattgtatctgtgcctagg

SEQ ID NO: 87994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcaaccatctaggattgta

SEQ ID NO: 87995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggttaatcaaccatctagg

SEQ ID NO: 87996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttagggttaatcaaccat

SEQ ID NO: 87997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggcaaaaattaagttagg

SEQ ID NO: 87998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggcaaaaattaagttag

SEQ ID NO: 87999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatggcaaaaattaagtta

SEQ ID NO: 88000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttaatggcaaaaattaag

SEQ ID NO: 88001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataaactattttaatggca

SEQ ID NO: 88002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaactgcataaactatttta

SEQ ID NO: 88003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaactgcataaactatttt

SEQ ID NO: 88004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cgtacaagcttcaaactgca

SEQ ID NO: 88005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcgtacaagcttcaaactgc

SEQ ID NO: 88006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcgtacaagcttcaaac

SEQ ID NO: 88007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatttgcgtacaagcttca

SEQ ID NO: 88008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgttatttgcgtacaagc

SEQ ID NO: 88009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccctgttatttgcgtacaa

SEQ ID NO: 88010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctccctgttatttgcgtaca

SEQ ID NO: 88011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtatagcttctccctgtta

SEQ ID NO: 88012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtatagcttctccctgtt

SEQ ID NO: 88013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagtatagcttctccctgt

SEQ ID NO: 88014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagtatagcttctccctg

SEQ ID NO: 88015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggaaatgaaatcttttca

SEQ ID NO: 88016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatggaaatgaaatcttttc

SEQ ID NO: 88017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatttaatggaaatgaaatc

SEQ ID NO: 88018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggatttaatggaaatgaaat

SEQ ID NO: 88019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaataaatgtgtcttggat

SEQ ID NO: 88020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaaataaatgtgtcttgg

SEQ ID NO: 88021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgcaaataaatgtgtcttg

SEQ ID NO: 88022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgcaaataaatgtgtctt

SEQ ID NO: 88023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcacatgtgcaactttctg

SEQ ID NO: 88024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaccccaaattagtcaca

SEQ ID NO: 88025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccatattaataaccccaa

SEQ ID NO: 88026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattcaaccatattaataac

SEQ ID NO: 88027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattcaaccatattaataa

SEQ ID NO: 88028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatttatattcaaccatatt

SEQ ID NO: 88029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatatttatattcaaccat

SEQ ID NO: 88030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctatatttatattcaacca

SEQ ID NO: 88031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaatgaaaatttgctatat

SEQ ID NO: 88032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccaatgaaaatttgctat

SEQ ID NO: 88033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccaatgaaaatttgcta

SEQ ID NO: 88034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccaatgaaaatttgct

SEQ ID NO: 88035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattttctcccaatgaaaat

SEQ ID NO: 88036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaattttctcccaatgaaa

SEQ ID NO: 88037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaaattttctcccaatgaa

SEQ ID NO: 88038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaaattttctcccaatga

SEQ ID NO: 88039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttttctaaattttctccc

SEQ ID NO: 88040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagttttctaaattttctcc

SEQ ID NO: 88041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagttttctaaattttctc

SEQ ID NO: 88042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagttttctaaattttct

SEQ ID NO: 88043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcttttcagttttctaaat

SEQ ID NO: 88044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgcttttcagttttctaa

SEQ ID NO: 88045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgcttttcagttttcta

SEQ ID NO: 88046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatgcttttcagttttct

SEQ ID NO: 88047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctatgcttttcagttttc

SEQ ID NO: 88048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctatgcttttcagtttt

SEQ ID NO: 88049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttctatgcttttcagttt

SEQ ID NO: 88050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttctatgcttttcag

SEQ ID NO: 88051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttctatgcttttca

SEQ ID NO: 88052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttatttttttctatgctt

SEQ ID NO: 88053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttatttttttctatgct

SEQ ID NO: 88054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttcatttatttttttcta

SEQ ID NO: 88055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaataggttaatttcattta

SEQ ID NO: 88056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaataggttaatttcattt

SEQ ID NO: 88057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggaataggttaatttcat

SEQ ID NO: 88058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttggaataggttaatttca

SEQ ID NO: 88059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttggaataggttaatttc

SEQ ID NO: 88060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaaatcagtaattt

SEQ ID NO: 88061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaaaaaatcagtaatt

SEQ ID NO: 88062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaaaaaaaatcagtaat

SEQ ID NO: 88063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaaaaaaaaaatcagta

SEQ ID NO: 88064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctctttaaaaaaaaaaatc

SEQ ID NO: 88065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtaacagtaggagacattg

SEQ ID NO: 88066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caccacagcctgggtaacag

SEQ ID NO: 88067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgattgcaccacagcctggg

SEQ ID NO: 88068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtcagctatgattgcacc

SEQ ID NO: 88069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggttgcagtcagctatga

SEQ ID NO: 88070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggttgcagtcagctatg

SEQ ID NO: 88071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcccatgaggtttggaggt

SEQ ID NO: 88072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcccatgaggtttggagg

SEQ ID NO: 88073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtgggaagaacacttgag

SEQ ID NO: 88074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggctgaggtgggaagaa

SEQ ID NO: 88075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaggctgaggtgggaaga

SEQ ID NO: 88076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttgggaggctgaggtggga

SEQ ID NO: 88077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctacttgggaggctgaggt

SEQ ID NO: 88078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtcctagctacttgggag

SEQ ID NO: 88079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccagacatagtggtgcaca

SEQ ID NO: 88080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaaattagccagac

SEQ ID NO: 88081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattaaaaaaaaaaattagc

SEQ ID NO: 88082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgacagagagagactcca

SEQ ID NO: 88083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctgggtgacagagaga

SEQ ID NO: 88084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagcctgggtgacag

SEQ ID NO: 88085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgatggagtgagccgag

SEQ ID NO: 88086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaagaggcagaggttgcag

SEQ ID NO: 88087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcccagtgctgccaagaggc

SEQ ID NO: 88088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatcccagtgctgccaaga

SEQ ID NO: 88089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgcctgttatcccagtgct

SEQ ID NO: 88090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtgtggtggctcatgcctg

SEQ ID NO: 88091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagtatgtatatatatata

SEQ ID NO: 88092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcagtatgtatatatatat

SEQ ID NO: 88093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtcagtatgtatatatata

SEQ ID NO: 88094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaacattttgtcagtatgt

SEQ ID NO: 88095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaaacattttgtcagtat

SEQ ID NO: 88096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggaaacattttgtcagta

SEQ ID NO: 88097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctggaaacattttgtcagt

SEQ ID NO: 88098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcctttctggaaacattt

SEQ ID NO: 88099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagcctttctggaaacatt

SEQ ID NO: 88100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatagcctttctggaaacat

SEQ ID NO: 88101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatagcctttctggaaaca

SEQ ID NO: 88102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatgatatacatttttat

SEQ ID NO: 88103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaaaatgatatacatttt

SEQ ID NO: 88104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgttgctaaaaatgatat

SEQ ID NO: 88105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acatgttgctaaaaatgata

SEQ ID NO: 88106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggaaaatatatgcttaca

SEQ ID NO: 88107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattgtgggaaaatatatg

SEQ ID NO: 88108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacattgtgggaaaatatat

SEQ ID NO: 88109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacttaacattgtgggaaaa

SEQ ID NO: 88110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgactatacttaacattg

SEQ ID NO: 88111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgactatacttaacatt

SEQ ID NO: 88112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatgactatacttaacat

SEQ ID NO: 88113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatgactatacttaaca

SEQ ID NO: 88114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaatgactatacttaac

SEQ ID NO: 88115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaatgactatacttaa

SEQ ID NO: 88116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaatgactatactta

SEQ ID NO: 88117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaaatgactatactt

SEQ ID NO: 88118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaagtttttttttaaatga

SEQ ID NO: 88119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatcaaattatgaagttt

SEQ ID NO: 88120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatcaaattatgaagtt

SEQ ID NO: 88121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatatcaaattatgaagt

SEQ ID NO: 88122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataaaaacgttttaaatat

SEQ ID NO: 88123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agataaaaacgttttaaata

SEQ ID NO: 88124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagataaaaacgttttaaat

SEQ ID NO: 88125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acattttagataaaaacgtt

SEQ ID NO: 88126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acgaaattcacattttagat

SEQ ID NO: 88127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacgaaattcacattttaga

SEQ ID NO: 88128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaatgtttcacgaaattca

SEQ ID NO: 88129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
accaaagaagaactagaaat

SEQ ID NO: 88130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagacactgaccaaagaaga

SEQ ID NO: 88131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatagaaaaaagatcaagag

SEQ ID NO: 88132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caatagaaaaaagatcaaga

SEQ ID NO: 88133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaaacaagaaaataatgaa

SEQ ID NO: 88134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcaaacaagaaaataatga

SEQ ID NO: 88135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcgtgtgcacacacacccac

SEQ ID NO: 88136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcgtgtgcacacacaccca

SEQ ID NO: 88137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaaaggtatcaatatcct

SEQ ID NO: 88138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaaaaggtatcaatatcc

SEQ ID NO: 88139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgaaaaggtatcaatatc

SEQ ID NO: 88140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgaaaaggtatcaatat

SEQ ID NO: 88141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaaaagaaaaaaaaaagaa

SEQ ID NO: 88142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagatgacaaactggcaaa

SEQ ID NO: 88143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaagacaaagttaaaaga

SEQ ID NO: 88144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaaagacaaagttaaaag

SEQ ID NO: 88145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtaaagacaaagttaaaa

SEQ ID NO: 88146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaccagttttagtaaaga

SEQ ID NO: 88147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaccagttttagtaaag

SEQ ID NO: 88148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaaccagttttagtaaa

SEQ ID NO: 88149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaaaaccagttttagtaa

SEQ ID NO: 88150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttgaaaaccagtttta

SEQ ID NO: 88151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcatttttgaaaaccagtt

SEQ ID NO: 88152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattcatttttgaaaaccag

SEQ ID NO: 88153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattcatttttgaaaacca

SEQ ID NO: 88154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatttctattcatttttg

SEQ ID NO: 88155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagagtaattatatatttct

SEQ ID NO: 88156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagagtaattatatatttc

SEQ ID NO: 88157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaagagtaattatatattt

SEQ ID NO: 88158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttaaagagtaattatata

SEQ ID NO: 88159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cataattcctttaaagagta

SEQ ID NO: 88160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcataattcctttaaaga

SEQ ID NO: 88161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttactgcataattcctt

SEQ ID NO: 88162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgttaaagttactgcataa

SEQ ID NO: 88163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgttaaagttactgcata

SEQ ID NO: 88164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatgttaaagttactgcat

SEQ ID NO: 88165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatgttaaagttactgca

SEQ ID NO: 88166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaatgggaaaacatatata

SEQ ID NO: 88167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctcccaatgggaaaacat

SEQ ID NO: 88168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagaaatatgtcatgaaaa

SEQ ID NO: 88169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagaaatatgtcatgaaa

SEQ ID NO: 88170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttcccagaaatatgtca

SEQ ID NO: 88171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcctatgtttcccagaaat

SEQ ID NO: 88172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggcctatgtttcccagaa

SEQ ID NO: 88173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaggcctatgtttcccaga

SEQ ID NO: 88174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttctaggcctatgtttcc

SEQ ID NO: 88175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaaaaaaaaaaaaaaatct

SEQ ID NO: 88176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaatctgtcaaaaaaaaaa

SEQ ID NO: 88177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagactgagaatctgtcaaa

SEQ ID NO: 88178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactccagactgagaatctg

SEQ ID NO: 88179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatcatgccactgcactcc

SEQ ID NO: 88180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtgagctgagatcatgcc

SEQ ID NO: 88181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatccaggaggcagaggtta

SEQ ID NO: 88182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatccaggaggcagaggtt

SEQ ID NO: 88183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaatcacttgaa

SEQ ID NO: 88184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaggctgaggcaggagaa

SEQ ID NO: 88185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcaggaggctgaggcagga

SEQ ID NO: 88186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagtcccagctactcaggag

SEQ ID NO: 88187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcgtggtggcaggcaccta

SEQ ID NO: 88188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctgggcgtggtggcaggca

SEQ ID NO: 88189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaatacaaaaattagctgg

SEQ ID NO: 88190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaatacaaaaattagc

SEQ ID NO: 88191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcgctactaaaaatacaaaa

SEQ ID NO: 88192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaacatggtgaaaccctg

SEQ ID NO: 88193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccaaggcgggcagat

SEQ ID NO: 88194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccaaggcgggcaga

SEQ ID NO: 88195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgggaggccaaggcgggcag

SEQ ID NO: 88196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatcccagcattttgggag

SEQ ID NO: 88197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acgcctgtaatcccagcatt

SEQ ID NO: 88198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaggcgcagtggctcacg

SEQ ID NO: 88199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggccaggcgcagtggctcac

SEQ ID NO: 88200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggccaggcgcagtggctca

SEQ ID NO: 88201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attttggccaggcgcagtgg

SEQ ID NO: 88202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgaaaaacctcattttgg

SEQ ID NO: 88203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagggactgtgtgaaaaacc

SEQ ID NO: 88204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agacaagactccagggactg

SEQ ID NO: 88205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acccagcctcagacaagact

SEQ ID NO: 88206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtaaagaagcagcctcac

SEQ ID NO: 88207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggtaaagaagcagcctca

SEQ ID NO: 88208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtttgaggtaaagaagcag

SEQ ID NO: 88209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcaggatagttcagtttga

SEQ ID NO: 88210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaaaagaaaagaggcagag

SEQ ID NO: 88211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggaggtggatgacccaaac

SEQ ID NO: 88212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaggaggtggatgacccaa

SEQ ID NO: 88213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacagtagctctgaggaggt

SEQ ID NO: 88214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataaaaaaatgttgtacag

SEQ ID NO: 88215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacaaaaatctaaataaaaa

SEQ ID NO: 88216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttatacaaaaatctaaata

SEQ ID NO: 88217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgttatacaaaaatctaaat

SEQ ID NO: 88218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagaaacttcgttatacaaa

SEQ ID NO: 88219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattaaagaaacttcgttat

SEQ ID NO: 88220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatagagtcatctgcatta

SEQ ID NO: 88221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatagagtcatctgcatt

SEQ ID NO: 88222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttagaatagagtcatctgc

SEQ ID NO: 88223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttagaatagagtcatctg

SEQ ID NO: 88224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atataaggtttatttagaat

SEQ ID NO: 88225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgtgtaaaaatgtagagt

SEQ ID NO: 88226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaccattatgtgtgtaaa

SEQ ID NO: 88227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaccattatgtgtgtaa

SEQ ID NO: 88228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcaaaccattatgtgtgta

SEQ ID NO: 88229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcaaaccattatgtgtgt

SEQ ID NO: 88230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgcaaaccattatgtgtg

SEQ ID NO: 88231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgaatgaatgaatgaatg

SEQ ID NO: 88232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatgaatgaatgaatgaat

SEQ ID NO: 88233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatgaacttgaatgaatga

SEQ ID NO: 88234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatatgtctggaatgaact

SEQ ID NO: 88235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaatatgtctggaatgaa

SEQ ID NO: 88236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctaaaatatgtctggaat

SEQ ID NO: 88237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatgataatcaaataatag

SEQ ID NO: 88238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggatgataatcaaataata

SEQ ID NO: 88239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgcttaggatgataatcaa

SEQ ID NO: 88240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgcttaggatgataatc

SEQ ID NO: 88241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctgatgcttaggatgata

SEQ ID NO: 88242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgctctgatgcttaggat

SEQ ID NO: 88243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaactgctctgatgcttag

SEQ ID NO: 88244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagttactaactgctctgat

SEQ ID NO: 88245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggagttactaactgctctga

SEQ ID NO: 88246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggagttactaactgctct

SEQ ID NO: 88247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcttggagttactaactgc

SEQ ID NO: 88248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttcttggagttactaact

SEQ ID NO: 88249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatgttctgttcttggag

SEQ ID NO: 88250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaatgttctgttcttgga

SEQ ID NO: 88251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttaaaaatgttctgttc

SEQ ID NO: 88252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacttaaaaatgttctgtt

SEQ ID NO: 88253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaacttaaaaatgttctgt

SEQ ID NO: 88254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaacttaaaaatgttctg

SEQ ID NO: 88255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttttcaacttaaaaatgt

SEQ ID NO: 88256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacctaacttttcaacttaa

SEQ ID NO: 88257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggacctaacttttcaactta

SEQ ID NO: 88258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatttggacctaacttttc

SEQ ID NO: 88259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggggaaaaaatgggagtca

SEQ ID NO: 88260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggggaaaaaatgggagtc

SEQ ID NO: 88261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatggggaaaaaatggga

SEQ ID NO: 88262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaataaatataagaatgc

SEQ ID NO: 88263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caaaaataaatataagaatg

SEQ ID NO: 88264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaaaaataaatataagaa

SEQ ID NO: 88265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttcaaaaataaatataa

SEQ ID NO: 88266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttcaaaaataaatata

SEQ ID NO: 88267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatttattcttcaaaaataa

SEQ ID NO: 88268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggctaaatttattcttcaa

SEQ ID NO: 88269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggctaaatttattcttca

SEQ ID NO: 88270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggctaaatttattcttc

SEQ ID NO: 88271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttttgtggctaaatttat

SEQ ID NO: 88272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttttgtggctaaattta

SEQ ID NO: 88273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagttttgtggctaaattt

SEQ ID NO: 88274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagttttgtggctaaatt

SEQ ID NO: 88275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatacttttgagttttgt

SEQ ID NO: 88276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gttatacatacttttgagtt

SEQ ID NO: 88277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgttatacatacttttgagt

SEQ ID NO: 88278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgttatacatacttttgag

SEQ ID NO: 88279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcgttatacatacttttga

SEQ ID NO: 88280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcgttatacatacttt

SEQ ID NO: 88281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagagtgagagaattatttt

SEQ ID NO: 88282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaaacattgaagagtgaga

SEQ ID NO: 88283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gatggctgggaaacattgaa

SEQ ID NO: 88284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggatggctgggaaacattga

SEQ ID NO: 88285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccacaggggaggaatttgg

SEQ ID NO: 88286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggttgtccacaggggagga

SEQ ID NO: 88287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtactgtggttgtccacagg

SEQ ID NO: 88288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataaaaccacatggatggat

SEQ ID NO: 88289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgaaaagaaaaatgaata

SEQ ID NO: 88290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgaaaagaaaaatgaat

SEQ ID NO: 88291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcatgaaaagaaaaatg

SEQ ID NO: 88292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatagggtattatttgcatg

SEQ ID NO: 88293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatagggtattatttgcat

SEQ ID NO: 88294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtgacgaaggaaggtatga

SEQ ID NO: 88295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagtgacgaaggaaggtatg

SEQ ID NO: 88296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagtgacgaaggaaggtat

SEQ ID NO: 88297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagtgacgaaggaaggta

SEQ ID NO: 88298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttttaagtgacgaaggaa

SEQ ID NO: 88299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagtctgatttttaagtga

SEQ ID NO: 88300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaagtctgatttttaagtg

SEQ ID NO: 88301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atacagaaagatttccaagt

SEQ ID NO: 88302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatgctgatacagaaaga

SEQ ID NO: 88303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacatgctgatacagaaag

SEQ ID NO: 88304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatacatgctgatacagaaa

SEQ ID NO: 88305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaaagaagtagctttata

SEQ ID NO: 88306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctataaaaagaagtagcttt

SEQ ID NO: 88307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaagctgctataaaaagaa

SEQ ID NO: 88308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaagctgctataaaaaga

SEQ ID NO: 88309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgaagctgctataaaaag

SEQ ID NO: 88310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacaataggactttatgaag

SEQ ID NO: 88311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggtacagctgtacaatagga

SEQ ID NO: 88312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggtacagctgtacaatagg

SEQ ID NO: 88313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataatttgggtacagctgt

SEQ ID NO: 88314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagtgtgggaatgactaaat

SEQ ID NO: 88315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacagtgtgggaatgactaa

SEQ ID NO: 88316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgttctacagtgtgggaa

SEQ ID NO: 88317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaacaacctaaatgttct

SEQ ID NO: 88318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaaacaacctaaatgttc

SEQ ID NO: 88319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaaacaacctaaatgtt

SEQ ID NO: 88320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagctttgggaaacaaccta

SEQ ID NO: 88321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtagctttgggaaacaac

SEQ ID NO: 88322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgagaagataattattgta

SEQ ID NO: 88323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaagaaaaaaactaatg

SEQ ID NO: 88324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaagagcccacaaaaga

SEQ ID NO: 88325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataaaagttacaaaaaga

SEQ ID NO: 88326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaataaaagttacaaaaag

SEQ ID NO: 88327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacttaaaataaaagttaca

SEQ ID NO: 88328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcatgtacccctgaactta

SEQ ID NO: 88329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtaacaaacctgtgcatgt

SEQ ID NO: 88330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgtgtaacaaacctgtgc

SEQ ID NO: 88331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctgtgtaacaaacctgtg

SEQ ID NO: 88332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taacacaagtttccctgtgt

SEQ ID NO: 88333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgatgaaataagatgtaga

SEQ ID NO: 88334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtgatgaaataagatgtag

SEQ ID NO: 88335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaccttggtgatgaaataa

SEQ ID NO: 88336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagaccttggtgatgaaata

SEQ ID NO: 88337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttaagaccttggtgatga

SEQ ID NO: 88338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcttaagaccttggtgatg

SEQ ID NO: 88339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataagtacttggcttaagac

SEQ ID NO: 88340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagggtggagggtggcagga

SEQ ID NO: 88341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggcccattggagggtggag

SEQ ID NO: 88342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgatgagaacacatggac

SEQ ID NO: 88343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtgagagctaaatgatg

SEQ ID NO: 88344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataagtgagagctaaatgat

SEQ ID NO: 88345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttataagtgagagctaaa

SEQ ID NO: 88346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagagaatgtcctcacttat

SEQ ID NO: 88347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcaagagaatgtcctcact

SEQ ID NO: 88348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaactattcaagagaatg

SEQ ID NO: 88349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaataaaataccgtactgt

SEQ ID NO: 88350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaataaaataccgtactg

SEQ ID NO: 88351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttacaaataaaataccgt

SEQ ID NO: 88352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttacaaataaaataccg

SEQ ID NO: 88353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagcatttgtcttacaaata

SEQ ID NO: 88354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaagcatttgtcttacaaa

SEQ ID NO: 88355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctgaagcatttgtctta

SEQ ID NO: 88356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactctgaagcatttgtctt

SEQ ID NO: 88357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcaatttcactctgaagca

SEQ ID NO: 88358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgactcagcaatttcactct

SEQ ID NO: 88359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacgcacatacaattatg

SEQ ID NO: 88360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggcaaattaaaaacgcaca

SEQ ID NO: 88361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatggcaaattaaaaacgc

SEQ ID NO: 88362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatggcaaattaaaaacg

SEQ ID NO: 88363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattatggcaaattaaaaac

SEQ ID NO: 88364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggcaatattttattatggca

SEQ ID NO: 88365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtaacaaaagagaattcgg

SEQ ID NO: 88366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cactaggtaacaaaagagaa

SEQ ID NO: 88367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggcgttacactaggtaac

SEQ ID NO: 88368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggccctgtaggcgttacac

SEQ ID NO: 88369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctatggccctgtaggcgt

SEQ ID NO: 88370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtaggatagaaattcagc

SEQ ID NO: 88371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagatcagcagagttagggt

SEQ ID NO: 88372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagatcagcagagttaggg

SEQ ID NO: 88373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaagatcagcagagttag

SEQ ID NO: 88374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaagatcagcagagtta

SEQ ID NO: 88375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcttaaagatcagcagag

SEQ ID NO: 88376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctgtttcttaaagatcagc

SEQ ID NO: 88377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acctgtttcttaaagatcag

SEQ ID NO: 88378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacctgtttcttaaagatca

SEQ ID NO: 88379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaatggaacattttacctg

SEQ ID NO: 88380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttacaaatggaacatttta

SEQ ID NO: 88381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggttacaaatggaacattt

SEQ ID NO: 88382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctggttacaaatggaaca

SEQ ID NO: 88383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctgctctggttacaaatg

SEQ ID NO: 88384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcaatctcagctgctctgg

SEQ ID NO: 88385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagcaatctcagctgctct

SEQ ID NO: 88386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttctaagcaatctcagctg

SEQ ID NO: 88387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttctaagcaatctcagct

SEQ ID NO: 88388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttggttctaagcaatctc

SEQ ID NO: 88389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcaactatcttggttctaa

SEQ ID NO: 88390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtcaactatcttggttcta

SEQ ID NO: 88391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtcaactatcttggttct

SEQ ID NO: 88392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtcctttagtcaactatc

SEQ ID NO: 88393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagtcctttagtcaactat

SEQ ID NO: 88394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaagtcctttagtcaact

SEQ ID NO: 88395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgaagtcctttagtcaac

SEQ ID NO: 88396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggtcttcttgaagtccttt

SEQ ID NO: 88397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatgatgcctgaggtcttc

SEQ ID NO: 88398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatgaaaatgagattataa

SEQ ID NO: 88399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcatgaaaatgagattata

SEQ ID NO: 88400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgggggtgtcatttagcat

SEQ ID NO: 88401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatggcactggtgggggtg

SEQ ID NO: 88402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaactgtcatggcactggt

SEQ ID NO: 88403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatggggattatcaactgt

SEQ ID NO: 88404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcattgtcatggggattat

SEQ ID NO: 88405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtcattgtcatggggatt

SEQ ID NO: 88406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggtcattgtcatggggat

SEQ ID NO: 88407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctggtcattgtcatgggg

SEQ ID NO: 88408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttctggtcattgtcatggg

SEQ ID NO: 88409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggcttcttctggtcattgt

SEQ ID NO: 88410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggcttcttctggtcattg

SEQ ID NO: 88411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatggcttcttctggtcatt

SEQ ID NO: 88412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatggcttcttctggtcat

SEQ ID NO: 88413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccttttatggcttcttctg

SEQ ID NO: 88414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccttttatggcttcttct

SEQ ID NO: 88415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtccttttatggcttcttc

SEQ ID NO: 88416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtccttttatggcttctt

SEQ ID NO: 88417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttgtccttttatggcttct

SEQ ID NO: 88418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttttgtccttttatggct

SEQ ID NO: 88419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttttgtccttttatggc

SEQ ID NO: 88420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaccagagtgccgccttcc

SEQ ID NO: 88421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaccagagtgccgccttc

SEQ ID NO: 88422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggaaccagagtgccgcct

SEQ ID NO: 88423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttggaaccagagtgccgcc

SEQ ID NO: 88424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaaataggtggtgaactt

SEQ ID NO: 88425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagaaataggtggtgaact

SEQ ID NO: 88426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccagaaataggtggtgaac

SEQ ID NO: 88427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccagaaataggtggtgaa

SEQ ID NO: 88428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtcttttccagaaatagg

SEQ ID NO: 88429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagtgaggggaggaatgtt

SEQ ID NO: 88430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcattaagagtgaggggag

SEQ ID NO: 88431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaagaagttggtcattaa

SEQ ID NO: 88432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatagaaagtatatctaat

SEQ ID NO: 88433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgaggagtgaggaaattga

SEQ ID NO: 88434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actagtgaggagtgaggaaa

SEQ ID NO: 88435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactagtgaggagtgaggaa

SEQ ID NO: 88436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgactagtgaggagtgagg

SEQ ID NO: 88437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgactagtgaggagtgag

SEQ ID NO: 88438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttcttgactagtgaggag

SEQ ID NO: 88439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatggccaaagaatggagaa

SEQ ID NO: 88440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcgatggccaaagaatgga

SEQ ID NO: 88441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcgatggccaaagaatgg

SEQ ID NO: 88442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattcgatggccaaagaatg

SEQ ID NO: 88443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagacccaatacaagaaatg

SEQ ID NO: 88444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattggagacccaatacaa

SEQ ID NO: 88445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtattggagacccaataca

SEQ ID NO: 88446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttggtattggagacccaat

SEQ ID NO: 88447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgtttggtattggagacc

SEQ ID NO: 88448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctgtttggtattggagac

SEQ ID NO: 88449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctgtttggtattggaga

SEQ ID NO: 88450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaggtggcatctttccct

SEQ ID NO: 88451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaaggtggcatctttccc

SEQ ID NO: 88452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagtttcaaaaggtggcat

SEQ ID NO: 88453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtagtttcaaaaggtggca

SEQ ID NO: 88454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttggtagtttcaaaaggtg

SEQ ID NO: 88455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaatataccaataacctcc

SEQ ID NO: 88456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaggagttaccaatatac

SEQ ID NO: 88457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaaggagttaccaatata

SEQ ID NO: 88458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgaaggagttaccaatat

SEQ ID NO: 88459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataggcctttatgaaggagt

SEQ ID NO: 88460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggagagcatggattgatag

SEQ ID NO: 88461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggagagcatggattgata

SEQ ID NO: 88462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttggggagagcatggattg

SEQ ID NO: 88463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acacattgtttggggagagc

SEQ ID NO: 88464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggtatgtgcaaacaatcc

SEQ ID NO: 88465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaaggtatgtgcaaacaa

SEQ ID NO: 88466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaaggtatgtgcaaaca

SEQ ID NO: 88467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattgaaggtatgtgcaaac

SEQ ID NO: 88468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaatactttattgaaggt

SEQ ID NO: 88469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaaatactttattgaagg

SEQ ID NO: 88470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaagatgaaaaaaaattt

SEQ ID NO: 88471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggctcacaaagatgaaaaaa

SEQ ID NO: 88472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaggctcacaaagatgaaa

SEQ ID NO: 88473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attaggctcacaaagatgaa

SEQ ID NO: 88474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccacttattaggctcacaa

SEQ ID NO: 88475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttccccacttattaggctca

SEQ ID NO: 88476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attccccacttattaggctc

SEQ ID NO: 88477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattccccacttattaggct

SEQ ID NO: 88478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaataaataaataaataaa

SEQ ID NO: 88479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catctcaaaataaataaata

SEQ ID NO: 88480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaatgagagagcgactcc

SEQ ID NO: 88481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcctgggcaatgagagag

SEQ ID NO: 88482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatcgcaccaaggcactcc

SEQ ID NO: 88483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagctgagatcgcacc

SEQ ID NO: 88484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacccaggaggcagatgttg

SEQ ID NO: 88485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacccaggaggcagatgtt

SEQ ID NO: 88486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgaacccaggaggcagat

SEQ ID NO: 88487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaactgcttgaa

SEQ ID NO: 88488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggaggctgaggcaggagaa

SEQ ID NO: 88489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcaggaggctgaggcagga

SEQ ID NO: 88490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atccgagctactcaggaggc

SEQ ID NO: 88491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taatccgagctactcaggag

SEQ ID NO: 88492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccgggtgtggtggtgggta

SEQ ID NO: 88493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaggtacaaaaattagccgg

SEQ ID NO: 88494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaggtacaaaaattagc

SEQ ID NO: 88495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaggtacaaaaatta

SEQ ID NO: 88496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctctactaaaggtacaaaa

SEQ ID NO: 88497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaacatggtgaaaacctg

SEQ ID NO: 88498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagaccagcctggccaacat

SEQ ID NO: 88499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatgggtggatcacatgag

SEQ ID NO: 88500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaagctgagatgggtggat

SEQ ID NO: 88501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaagctgagatgggtgga

SEQ ID NO: 88502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaagctgagatgggtgg

SEQ ID NO: 88503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatcccagcactttgggaa

SEQ ID NO: 88504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatcccagcactttggga

SEQ ID NO: 88505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgtttgtgatcccagcact

SEQ ID NO: 88506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ggccgggtgtggtggctcat

SEQ ID NO: 88507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cggccgggtgtggtggctca

SEQ ID NO: 88508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcggccgggtgtggtggctc

SEQ ID NO: 88509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaagttttcggccgggtgt

SEQ ID NO: 88510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgataagaattaagaag

SEQ ID NO: 88511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaaaagaaaatgcaaacta

SEQ ID NO: 88512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcacaaaagaaaatgcaa

SEQ ID NO: 88513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcactcacaaaagaaaa

SEQ ID NO: 88514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggatatgaaaagatccctg

SEQ ID NO: 88515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catacagacagagcacagaa

SEQ ID NO: 88516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaagtggacaagactaca

SEQ ID NO: 88517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaaaaagtggacaagact

SEQ ID NO: 88518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atagtctattaaaaaagtgg

SEQ ID NO: 88519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaacactgatagtctat

SEQ ID NO: 88520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattaataaaacactgatag

SEQ ID NO: 88521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaaattaataaaacactga

SEQ ID NO: 88522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagttcctaaattaataaa

SEQ ID NO: 88523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaagagttcctaaattaat

SEQ ID NO: 88524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaagagttcctaaattaa

SEQ ID NO: 88525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaagagttcctaaatta

SEQ ID NO: 88526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgttaagagttcctaaa

SEQ ID NO: 88527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattttgttaagagttcct

SEQ ID NO: 88528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attattttgttaagagttcc

SEQ ID NO: 88529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattattttgttaagagttc

SEQ ID NO: 88530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttattattttgttaaga

SEQ ID NO: 88531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataccacagaaaaaaagct

SEQ ID NO: 88532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattgtataccacagaaaaa

SEQ ID NO: 88533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattgtataccacagaaaa

SEQ ID NO: 88534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaaaatatttgtattgtat

SEQ ID NO: 88535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaaaaatatttgtattgta

SEQ ID NO: 88536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccataaaccaaaagaaacaa

SEQ ID NO: 88537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagataaactaccataaac

SEQ ID NO: 88538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagataaactaccataaa

SEQ ID NO: 88539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaagataaactaccataa

SEQ ID NO: 88540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaagataaactaccata

SEQ ID NO: 88541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtagatgcttttaaaa

SEQ ID NO: 88542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaaatgtagatgctttt

SEQ ID NO: 88543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaaaatgtagatgcttt

SEQ ID NO: 88544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatttaattaaaatgtagat

SEQ ID NO: 88545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgaattcaatttaattaaa

SEQ ID NO: 88546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagaaaggattggtgaattc

SEQ ID NO: 88547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agataatataaaacacagga

SEQ ID NO: 88548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagataatataaaacacag

SEQ ID NO: 88549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagataatataaaacaca

SEQ ID NO: 88550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaagataatataaaacac

SEQ ID NO: 88551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttctaagataatataaaa

SEQ ID NO: 88552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtagaaattattttctaa

SEQ ID NO: 88553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaagtagaaattattttcta

SEQ ID NO: 88554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaagtacttgaagtagaaa

SEQ ID NO: 88555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgaagtacttgaagtagaa

SEQ ID NO: 88556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acatatgcatgtgaaaaccc

SEQ ID NO: 88557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggaggaatatctcacata

SEQ ID NO: 88558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagggaggaatatctcacat

SEQ ID NO: 88559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaggtttgagggaggaata

SEQ ID NO: 88560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatggataatatatcaatg

SEQ ID NO: 88561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acctgagatggataatatat

SEQ ID NO: 88562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacctgagatggataatata

SEQ ID NO: 88563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacctgagatggataatat

SEQ ID NO: 88564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcacctgagatggataata

SEQ ID NO: 88565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcacctgagatggataa

SEQ ID NO: 88566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttcacctgagatggata

SEQ ID NO: 88567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttcacctgagatggat

SEQ ID NO: 88568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttttcacctgagatgga

SEQ ID NO: 88569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttttcacctgagatgg

SEQ ID NO: 88570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttcttttcacctgagatg

SEQ ID NO: 88571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttcttttcacctgaga

SEQ ID NO: 88572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttcttttcacctgag

SEQ ID NO: 88573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttttcttttcacctga

SEQ ID NO: 88574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcttttttcttttcacc

SEQ ID NO: 88575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttcttttttcttttcac

SEQ ID NO: 88576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttcttttttcttttca

SEQ ID NO: 88577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagaaaacatgtgaaggtt

SEQ ID NO: 88578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctagaagaaaacatgtgaag

SEQ ID NO: 88579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataacatacaaaccacaa

SEQ ID NO: 88580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataacatacaaaccaca

SEQ ID NO: 88581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtggaatcaaatatttaaaa

SEQ ID NO: 88582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtggaatcaaatatttaaa

SEQ ID NO: 88583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtggaatcaaatatttaa

SEQ ID NO: 88584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acccaagatacattttagtg

SEQ ID NO: 88585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccacctaacccaagatacat

SEQ ID NO: 88586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccacctaacccaagataca

SEQ ID NO: 88587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgccacctaacccaagatac

SEQ ID NO: 88588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctttgccacctaacccaaga

SEQ ID NO: 88589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgctttgccacctaaccca

SEQ ID NO: 88590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattactgctttgccacct

SEQ ID NO: 88591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtagtcatgtggataaaaa

SEQ ID NO: 88592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggacacctgggtagtcatgt

SEQ ID NO: 88593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattgggacacctgggtag

SEQ ID NO: 88594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atagttatcattgggacacc

SEQ ID NO: 88595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatagttatcattgggacac

SEQ ID NO: 88596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatagttatcattggga

SEQ ID NO: 88597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagaaatattatttaatag

SEQ ID NO: 88598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataggttgaaagaaatatt

SEQ ID NO: 88599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaataggttgaaagaaatat

SEQ ID NO: 88600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaggtagcatcttaaata

SEQ ID NO: 88601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catatgagaattataaaggt

SEQ ID NO: 88602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagaaaatacgatatccag

SEQ ID NO: 88603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggaagaaaatacgatat

SEQ ID NO: 88604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catagatagttcattggaag

SEQ ID NO: 88605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatagtatggtgacctaca

SEQ ID NO: 88606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcaaatagggtaattaaaa

SEQ ID NO: 88607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcaaatagggtaattaaa

SEQ ID NO: 88608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgcaaatagggtaattaa

SEQ ID NO: 88609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttatgcaaatagggtaat

SEQ ID NO: 88610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atacataatgttattttatg

SEQ ID NO: 88611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagcaccaaccctaataca

SEQ ID NO: 88612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacacacataaaagagtaat

SEQ ID NO: 88613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaattgtacacacataaa

SEQ ID NO: 88614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttgggaaattgtacacaca

SEQ ID NO: 88615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatctagttgggaaattgta

SEQ ID NO: 88616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataatctggatctagttgg

SEQ ID NO: 88617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaattagataatctggatct

SEQ ID NO: 88618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaattagataatctggatc

SEQ ID NO: 88619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatttggaattagataatc

SEQ ID NO: 88620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatttggaattagataat

SEQ ID NO: 88621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccatttggaattagataa

SEQ ID NO: 88622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatcccaatgaaaataaaa

SEQ ID NO: 88623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagacattgcaatcccaa

SEQ ID NO: 88624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagacattgcaatccca

SEQ ID NO: 88625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttataaagacattgcaat

SEQ ID NO: 88626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttataaagacattgcaa

SEQ ID NO: 88627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatttataaagacattgca

SEQ ID NO: 88628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaatttataaagacattgc

SEQ ID NO: 88629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accttttaatttataaagac

SEQ ID NO: 88630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccttttaatttataaaga

SEQ ID NO: 88631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccttttaatttataaag

SEQ ID NO: 88632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaccttttaatttataaa

SEQ ID NO: 88633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttaaccttttaatttat

SEQ ID NO: 88634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcagttccttttaacctttt

SEQ ID NO: 88635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccattggcagttccttttaa

SEQ ID NO: 88636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accattggcagttcctttta

SEQ ID NO: 88637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaagagtcagagtgctt

SEQ ID NO: 88638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagaagaggtattaaaaaaa

SEQ ID NO: 88639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatctaaagaagaggtatt

SEQ ID NO: 88640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatctaaagaagaggtat

SEQ ID NO: 88641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatctaaagaagaggta

SEQ ID NO: 88642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataatctaaagaagaggt

SEQ ID NO: 88643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttataatctaaagaaga

SEQ ID NO: 88644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttttataatctaaagaag

SEQ ID NO: 88645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtttttataatctaaagaa

SEQ ID NO: 88646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatactttgtttttataat

SEQ ID NO: 88647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcatactttgtttttataa

SEQ ID NO: 88648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacttggcatactttgtttt

SEQ ID NO: 88649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatattatacttggcatac

SEQ ID NO: 88650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgatattatacttggcata

SEQ ID NO: 88651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtgatattatacttggca

SEQ ID NO: 88652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtgatattatacttggc

SEQ ID NO: 88653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgtgatattatacttgg

SEQ ID NO: 88654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttgtgatattatacttg

SEQ ID NO: 88655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttttcttgtgatattatac

SEQ ID NO: 88656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgtttttcttgtgatatt

SEQ ID NO: 88657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgagtagccagcctgcc

SEQ ID NO: 88658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaatgagtagccagcctg

SEQ ID NO: 88659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggttctaaaatgagtagc

SEQ ID NO: 88660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattagaggttctaaaatg

SEQ ID NO: 88661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacattagaggttctaaaat

SEQ ID NO: 88662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atacacttaacattagaggt

SEQ ID NO: 88663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatatattgatacacttaa

SEQ ID NO: 88664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatatattgatacactta

SEQ ID NO: 88665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttcatatatattgataca

SEQ ID NO: 88666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttcatatatattgatac

SEQ ID NO: 88667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttgatttcatatatatt

SEQ ID NO: 88668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatatattgtatttgattt

SEQ ID NO: 88669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatatattgtatttgatt

SEQ ID NO: 88670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtttcatatatattgtattt

SEQ ID NO: 88671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtttcatatatattgtatt

SEQ ID NO: 88672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaaaagtatttggtttca

SEQ ID NO: 88673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaaaagtatttggtttc

SEQ ID NO: 88674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcaatcaggcaagtattta

SEQ ID NO: 88675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagcaatcaggcaagtattt

SEQ ID NO: 88676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaggatgcaatggtaaga

SEQ ID NO: 88677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgaaggatgcaatggtaag

SEQ ID NO: 88678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttatgaaggatgcaatggt

SEQ ID NO: 88679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acataatgttacttatgaag

SEQ ID NO: 88680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgattaacataatgttac

SEQ ID NO: 88681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgattaacataatgtta

SEQ ID NO: 88682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttacatgattaacataatg

SEQ ID NO: 88683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttacatgattaacataat

SEQ ID NO: 88684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatttatttacatgatta

SEQ ID NO: 88685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaatttatttacatgatt

SEQ ID NO: 88686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagaatttatttacatgat

SEQ ID NO: 88687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaagaatttatttacat

SEQ ID NO: 88688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaaataataattattttaa

SEQ ID NO: 88689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagaaataataattatttt

SEQ ID NO: 88690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagaaataataattattt

SEQ ID NO: 88691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcatttctaagaaataata

SEQ ID NO: 88692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaaattaagcatttctaag

SEQ ID NO: 88693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccatctaccaaattaagcat

SEQ ID NO: 88694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccatctaccaaattaagca

SEQ ID NO: 88695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttgccatctaccaaatta

SEQ ID NO: 88696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactgatttgccatctacca

SEQ ID NO: 88697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaactgatttgccatcta

SEQ ID NO: 88698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagttattaaactgatttgc

SEQ ID NO: 88699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaagttattaaactgatt

SEQ ID NO: 88700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgaagttattaaactgat

SEQ ID NO: 88701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttgaagttattaaactg

SEQ ID NO: 88702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcttgttgaagttattaaa

SEQ ID NO: 88703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactactcttgttgaagtta

SEQ ID NO: 88704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggacatgaaatattgaacta

SEQ ID NO: 88705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggacatgaaatattgaact

SEQ ID NO: 88706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggacatgaaatattgaac

SEQ ID NO: 88707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgattttaggacatgaaa

SEQ ID NO: 88708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaaatgccataaaattgaa

SEQ ID NO: 88709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctataaaatgccataaaatt

SEQ ID NO: 88710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aactactataaaatgccata

SEQ ID NO: 88711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcaactactataaaatgcc

SEQ ID NO: 88712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataccagttgttcaactac

SEQ ID NO: 88713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcataccagttgttcaacta

SEQ ID NO: 88714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcataccagttgttcaact

SEQ ID NO: 88715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgcataccagttgttca

SEQ ID NO: 88716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgcataccagttgttc

SEQ ID NO: 88717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttgttttgcataccagtt

SEQ ID NO: 88718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatttgttttgcataccagt

SEQ ID NO: 88719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgcatatacagcttaattt

SEQ ID NO: 88720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatataaaattatcgcatat

SEQ ID NO: 88721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctgaatataaaattatcgc

SEQ ID NO: 88722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcagttgtctgaatataaaa

SEQ ID NO: 88723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatagtccctatcagttg

SEQ ID NO: 88724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaatagtccctatcagtt

SEQ ID NO: 88725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataatcatagaatttagaaa

SEQ ID NO: 88726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataatcatagaatttagaa

SEQ ID NO: 88727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataatcatagaatttaga

SEQ ID NO: 88728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaatacccaaatcacaat

SEQ ID NO: 88729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagggtattatgaaataccc

SEQ ID NO: 88730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttacagggtattatgaaata

SEQ ID NO: 88731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataataaaataataaatata

SEQ ID NO: 88732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aataataaaataataaatat

SEQ ID NO: 88733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttaataataaaataataa

SEQ ID NO: 88734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcttaataataaaataat

SEQ ID NO: 88735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatcttaataataaaataa

SEQ ID NO: 88736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acttctatcttaataataaa

SEQ ID NO: 88737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacataagactaacttctat

SEQ ID NO: 88738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaggctatacataagacta

SEQ ID NO: 88739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaggctatacataagact

SEQ ID NO: 88740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaggctatacataagac

SEQ ID NO: 88741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattttaaaaggctatacat

SEQ ID NO: 88742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaatactatattttaaaa

SEQ ID NO: 88743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggaatactatattttaaa

SEQ ID NO: 88744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaacttgaggaatactata

SEQ ID NO: 88745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataaacttgaggaatactat

SEQ ID NO: 88746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttataaacttgaggaatact

SEQ ID NO: 88747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttataaacttgaggaatac

SEQ ID NO: 88748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttcttataaacttgagga

SEQ ID NO: 88749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttcttataaacttgagg

SEQ ID NO: 88750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttcttataaacttgag

SEQ ID NO: 88751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggcgtgagccaccacgcc

SEQ ID NO: 88752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattataggcgtgagccac

SEQ ID NO: 88753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaagtgctgggattatag

SEQ ID NO: 88754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccaaagtgctgggattata

SEQ ID NO: 88755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggcttcccaaagtgctggga

SEQ ID NO: 88756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcggcttcccaaagtgct

SEQ ID NO: 88757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtgatccgcctgcctcgg

SEQ ID NO: 88758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcaggtgatccgcctgc

SEQ ID NO: 88759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgacctcaggtgatccgcc

SEQ ID NO: 88760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattcctgacctcaggtgat

SEQ ID NO: 88761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaattcctgacctcaggtga

SEQ ID NO: 88762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcttgaattcctgacctca

SEQ ID NO: 88763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcaggctggtcttgaattc

SEQ ID NO: 88764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catgttggtcaggctggtct

SEQ ID NO: 88765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccatgttggtcaggctggt

SEQ ID NO: 88766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccatgttggtcaggctgg

SEQ ID NO: 88767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacggggtttctcca

SEQ ID NO: 88768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacggggtttctcc

SEQ ID NO: 88769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacggggtttctc

SEQ ID NO: 88770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagacggggtttct

SEQ ID NO: 88771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagacgggg

SEQ ID NO: 88772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagacggg

SEQ ID NO: 88773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagacgg

SEQ ID NO: 88774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgtatttttagtagag

SEQ ID NO: 88775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcatgcgccaccatgac

SEQ ID NO: 88776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaggcatgcgccac

SEQ ID NO: 88777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtagctgggattacaggca

SEQ ID NO: 88778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgagtagctgggattacag

SEQ ID NO: 88779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcctgagtagctggga

SEQ ID NO: 88780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcctgagtagct

SEQ ID NO: 88781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctcctgagta

SEQ ID NO: 88782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcctcctgag

SEQ ID NO: 88783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcagttctcctgcctcag

SEQ ID NO: 88784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgggttcaagcagttctcc

SEQ ID NO: 88785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caatccacctcccgggttca

SEQ ID NO: 88786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actacaatccacctcccggg

SEQ ID NO: 88787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agctcactacaatccacctc

SEQ ID NO: 88788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcaatggcccgatctc

SEQ ID NO: 88789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcaatgg

SEQ ID NO: 88790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcccaggctggagtgcaa

SEQ ID NO: 88791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgcccaggctggagtgca

SEQ ID NO: 88792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttgcccaggctggagtg

SEQ ID NO: 88793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gctcttgttgcccaggctgg

SEQ ID NO: 88794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgctcttgttgcccaggctg

SEQ ID NO: 88795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacagagtttcgctcttgt

SEQ ID NO: 88796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacagagtttcgctcttg

SEQ ID NO: 88797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagacagagtttcgctctt

SEQ ID NO: 88798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagacagagtttcgctct

SEQ ID NO: 88799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagacagagtttcgctc

SEQ ID NO: 88800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagacagagtttcgct

SEQ ID NO: 88801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagacagagtttcgc

SEQ ID NO: 88802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagacagagtttcg

SEQ ID NO: 88803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagacagagtttc

SEQ ID NO: 88804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagacagagttt

SEQ ID NO: 88805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagacagagtt

SEQ ID NO: 88806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagacagagt

SEQ ID NO: 88807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagacagag

SEQ ID NO: 88808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttgagacaga

SEQ ID NO: 88809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttgagacag

SEQ ID NO: 88810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttttttgagaca

SEQ ID NO: 88811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttttttttttttgaga

SEQ ID NO: 88812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttttttttttttgag

SEQ ID NO: 88813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttttttttttttttga

SEQ ID NO: 88814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttttttttttttttttg

SEQ ID NO: 88815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttctttttttttttttttt

SEQ ID NO: 88816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttttttttttttttt

SEQ ID NO: 88817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttctttttttttttttt

SEQ ID NO: 88818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttcttttttttttttt

SEQ ID NO: 88819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttctttttttttttt

SEQ ID NO: 88820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttcttttttttttt

SEQ ID NO: 88821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttctttttttttt

SEQ ID NO: 88822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttcttttttttt

SEQ ID NO: 88823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttttttctttttttt

SEQ ID NO: 88824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttttttttctttttt

SEQ ID NO: 88825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttttttttttcttttt

SEQ ID NO: 88826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttctttttttttttttct

SEQ ID NO: 88827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatttctttttttttttttc

SEQ ID NO: 88828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taatttcttttttttttttt

SEQ ID NO: 88829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaactttaatttctttttt

SEQ ID NO: 88830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattataaactttaatttc

SEQ ID NO: 88831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagattataaactttaattt

SEQ ID NO: 88832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaagattataaactttaat

SEQ ID NO: 88833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaagattataaactttaa

SEQ ID NO: 88834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagggtaatacacttctta

SEQ ID NO: 88835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccagggtaatacacttctt

SEQ ID NO: 88836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccagggtaatacacttct

SEQ ID NO: 88837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttttcccagggtaataca

SEQ ID NO: 88838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagttttcccagggtaatac

SEQ ID NO: 88839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcttaagttttcccagggt

SEQ ID NO: 88840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acactaatcttaagttttcc

SEQ ID NO: 88841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agatatgccagcaaatgttg

SEQ ID NO: 88842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacgttcagatatgccagc

SEQ ID NO: 88843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaacgttcagatatgcc

SEQ ID NO: 88844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attaaaacgttcagatatgc

SEQ ID NO: 88845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattaaaacgttcagatatg

SEQ ID NO: 88846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattaaaacgttcagatat

SEQ ID NO: 88847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattaaaacgttcagata

SEQ ID NO: 88848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaattttttattaaaacgt

SEQ ID NO: 88849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgaattttttattaaaacg

SEQ ID NO: 88850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatgaattttttattaaaac

SEQ ID NO: 88851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tacagataagactttatgaa

SEQ ID NO: 88852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacatgctgtacagataaga

SEQ ID NO: 88853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacatgctgtacagataag

SEQ ID NO: 88854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatacatgctgtacagataa

SEQ ID NO: 88855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttatacatgctgtacaga

SEQ ID NO: 88856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttatacatgctgtacag

SEQ ID NO: 88857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttcctttatacatgctgt

SEQ ID NO: 88858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcttcctttatacatgct

SEQ ID NO: 88859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtcttcctttatacatgc

SEQ ID NO: 88860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtcttcctttatacatg

SEQ ID NO: 88861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaagtattttctgtcttcc

SEQ ID NO: 88862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acgtgaactaagaagtattt

SEQ ID NO: 88863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacgtgaactaagaagtatt

SEQ ID NO: 88864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagagagatgggatttaac

SEQ ID NO: 88865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actaacagagagatgggatt

SEQ ID NO: 88866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactaacagagagatgggat

SEQ ID NO: 88867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aataaagtcttaactaacag

SEQ ID NO: 88868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaataaagtcttaactaac

SEQ ID NO: 88869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctctcaataaagtcttaa

SEQ ID NO: 88870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgctctcaataaagtctta

SEQ ID NO: 88871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgctctcaataaagtctt

SEQ ID NO: 88872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgataattttgtgctctcaa

SEQ ID NO: 88873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagccataagtctgtgataa

SEQ ID NO: 88874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcagccataagtctgtgat

SEQ ID NO: 88875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgcagccataagtctgt

SEQ ID NO: 88876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aataagggtatagaacctgt

SEQ ID NO: 88877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaataagggtatagaacctg

SEQ ID NO: 88878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaataagggtatagaac

SEQ ID NO: 88879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attatttaaataagggtata

SEQ ID NO: 88880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taattatttaaataagggta

SEQ ID NO: 88881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctaattatttaaataaggg

SEQ ID NO: 88882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctaattatttaaataag

SEQ ID NO: 88883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctctaattatttaaataa

SEQ ID NO: 88884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctctctaattatttaaata

SEQ ID NO: 88885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaatacattttctctctaa

SEQ ID NO: 88886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggaagtggatacatgtat

SEQ ID NO: 88887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagggaagtggatacatgta

SEQ ID NO: 88888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagggaagtggatacatgt

SEQ ID NO: 88889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttttgagggaagtggat

SEQ ID NO: 88890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatcatgttgatgttttgag

SEQ ID NO: 88891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaaatcatgttgatgtttt

SEQ ID NO: 88892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctaaatcatgttgatgtt

SEQ ID NO: 88893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcctaaatcatgttgatgt

SEQ ID NO: 88894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcctaaatcatgttgatg

SEQ ID NO: 88895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcactttctcctaaatcat

SEQ ID NO: 88896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatgcactttctcctaaat

SEQ ID NO: 88897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactatgcactttctccta

SEQ ID NO: 88898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgccaaagttattactatg

SEQ ID NO: 88899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctggtgccaaagttattac

SEQ ID NO: 88900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtctgcctggtgccaaagt

SEQ ID NO: 88901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaacctaagtctgcctggtg

SEQ ID NO: 88902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatggaataaacaggaaatt

SEQ ID NO: 88903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attatatggaataaacagga

SEQ ID NO: 88904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagagctaattatatggaat

SEQ ID NO: 88905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataatgctgcagagctaat

SEQ ID NO: 88906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcataatgctgcagagctaa

SEQ ID NO: 88907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggggaatttgcataatgct

SEQ ID NO: 88908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggggaatttgcataatgc

SEQ ID NO: 88909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttatggggaatttgcata

SEQ ID NO: 88910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttatggggaatttgcat

SEQ ID NO: 88911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatttatggggaatttgca

SEQ ID NO: 88912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcatttatggggaatttg

SEQ ID NO: 88913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctttcatttatggggaatt

SEQ ID NO: 88914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctctttcatttatggggaa

SEQ ID NO: 88915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctctttcatttatgggga

SEQ ID NO: 88916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagacagatatatttctct

SEQ ID NO: 88917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataagacagatatatttctc

SEQ ID NO: 88918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tataagacagatatatttct

SEQ ID NO: 88919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgataactttataagaca

SEQ ID NO: 88920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacatgataactttataaga

SEQ ID NO: 88921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctacatgataactttata

SEQ ID NO: 88922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattctacatgataacttta

SEQ ID NO: 88923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattctacatgataacttt

SEQ ID NO: 88924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccaaaaccatttctattcta

SEQ ID NO: 88925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accaaaaccatttctattct

SEQ ID NO: 88926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccaaaaccatttctattc

SEQ ID NO: 88927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtaggcactttaccaaaa

SEQ ID NO: 88928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcactgtggtaggcacttt

SEQ ID NO: 88929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctaggcactgtggtaggc

SEQ ID NO: 88930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcctaggcactgtggtagg

SEQ ID NO: 88931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttagcctaggcactgtggt

SEQ ID NO: 88932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttagcctaggcactgtgg

SEQ ID NO: 88933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttagcctaggcactg

SEQ ID NO: 88934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttatttatttagcctaggca

SEQ ID NO: 88935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgttatttatttagcctag

SEQ ID NO: 88936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctgttatttatttagccta

SEQ ID NO: 88937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatagggaagaaggataata

SEQ ID NO: 88938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtctgtatagggaagaagg

SEQ ID NO: 88939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtctgtatagggaagaag

SEQ ID NO: 88940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatttcagtctgtatagg

SEQ ID NO: 88941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatttcagtctgtatag

SEQ ID NO: 88942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaaaatttcagtctgta

SEQ ID NO: 88943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttaaaaatttcagtct

SEQ ID NO: 88944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attatttaaaaatttcagtc

SEQ ID NO: 88945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atggcttattatttaaaaat

SEQ ID NO: 88946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccaactcatggcttattat

SEQ ID NO: 88947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggccaactcatggcttat

SEQ ID NO: 88948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attggccaactcatggctta

SEQ ID NO: 88949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtttattggccaactcatg

SEQ ID NO: 88950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtttattggccaactcat

SEQ ID NO: 88951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgtttattggccaactca

SEQ ID NO: 88952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtaaggttttgtgtttattg

SEQ ID NO: 88953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtaaggttttgtgtttatt

SEQ ID NO: 88954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgtaaggttttgtgtttat

SEQ ID NO: 88955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacataagattttcgtaagg

SEQ ID NO: 88956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaagataaaacataggtaa

SEQ ID NO: 88957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcaagataaaacataggta

SEQ ID NO: 88958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagccataaacatgtttggc

SEQ ID NO: 88959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattaaagccataaacatgt

SEQ ID NO: 88960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattaaagccataaacatg

SEQ ID NO: 88961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaattaaagccataaacat

SEQ ID NO: 88962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattttaaattaaagccata

SEQ ID NO: 88963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagatctatattttaaatta

SEQ ID NO: 88964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcagatctatattttaaa

SEQ ID NO: 88965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgcagatctatattttaa

SEQ ID NO: 88966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgcagatctatatttta

SEQ ID NO: 88967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttactgcagatctatatt

SEQ ID NO: 88968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctattttactgcagatctat

SEQ ID NO: 88969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actattttactgcagatcta

SEQ ID NO: 88970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttactattttactgcaga

SEQ ID NO: 88971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctgtcttactattttact

SEQ ID NO: 88972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttatgctgtcttactatt

SEQ ID NO: 88973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaactgggttatgctgtct

SEQ ID NO: 88974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaactgggttatgctgtc

SEQ ID NO: 88975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagccatgaatttaacaact

SEQ ID NO: 88976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggagccatgaatttaacaa

SEQ ID NO: 88977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actctggagccatgaattta

SEQ ID NO: 88978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcactctggagccatgaatt

SEQ ID NO: 88979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctcactctggagccatgaa

SEQ ID NO: 88980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtaagcagtagagatgggat

SEQ ID NO: 88981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccaaggacataagctagta

SEQ ID NO: 88982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattccccaaggacataagc

SEQ ID NO: 88983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaaattccccaaggacat

SEQ ID NO: 88984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaagttaattaaattccc

SEQ ID NO: 88985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagaagttaattaaattcc

SEQ ID NO: 88986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagagaagttaattaaattc

SEQ ID NO: 88987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctttagagaagttaatta

SEQ ID NO: 88988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataagaactgagctttaga

SEQ ID NO: 88989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatataagaactgagcttt

SEQ ID NO: 88990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctatataagaactgagctt

SEQ ID NO: 88991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cggtttgctatataagaact

SEQ ID NO: 88992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctccggtttgctatataa

SEQ ID NO: 88993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagctccggtttgctatata

SEQ ID NO: 88994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagctccggtttgctatat

SEQ ID NO: 88995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattttcagctccggtttg

SEQ ID NO: 88996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggattatcattttcagct

SEQ ID NO: 88997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaggattatcattttcagc

SEQ ID NO: 88998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaataaccttaaaggattat

SEQ ID NO: 88999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactaaaataaccttaaagg

SEQ ID NO: 89000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactaaaataaccttaaag

SEQ ID NO: 89001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccactaaaataaccttaaa

SEQ ID NO: 89002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccactaaaataaccttaa

SEQ ID NO: 89003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccactaaaataacctta

SEQ ID NO: 89004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttttccactaaaataac

SEQ ID NO: 89005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtctaattttttccact

SEQ ID NO: 89006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattcagtgtctaattttt

SEQ ID NO: 89007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaaattcagtgtctaatt

SEQ ID NO: 89008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttattaaaattcagtgtc

SEQ ID NO: 89009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagtgtaacaggaaatgtg

SEQ ID NO: 89010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcactgaaagtgtaacagg

SEQ ID NO: 89011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatgtattgtgcactgaaa

SEQ ID NO: 89012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataataacagttacaatgta

SEQ ID NO: 89013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatcactaataataacagt

SEQ ID NO: 89014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaaatcactaataataac

SEQ ID NO: 89015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagaaagttgctaaaatca

SEQ ID NO: 89016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaagaaagttgctaaaatc

SEQ ID NO: 89017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatacaaaatcaacttag

SEQ ID NO: 89018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtatacaaaatcaactta

SEQ ID NO: 89019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggtatacaaaatcaactt

SEQ ID NO: 89020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctttaggtatacaaaatca

SEQ ID NO: 89021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaacattagctttaggtat

SEQ ID NO: 89022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaagaacattagctttagg

SEQ ID NO: 89023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gttcctaagaacattagctt

SEQ ID NO: 89024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcgttcctaagaacattagc

SEQ ID NO: 89025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagtaagcaaatatattc

SEQ ID NO: 89026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttataaagtaagcaaatata

SEQ ID NO: 89027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattataaagtaagcaaata

SEQ ID NO: 89028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattataaagtaagcaaat

SEQ ID NO: 89029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctattataaagtaagcaaa

SEQ ID NO: 89030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctattataaagtaagcaa

SEQ ID NO: 89031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatgcaatacaaaagctt

SEQ ID NO: 89032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatatgcaatacaaaagct

SEQ ID NO: 89033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatatgcaatacaaaagc

SEQ ID NO: 89034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaagaaaaggttttgtata

SEQ ID NO: 89035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctaagaagaaaaggttttg

SEQ ID NO: 89036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagctccctaagaagaaaa

SEQ ID NO: 89037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttgaaagctccctaagaa

SEQ ID NO: 89038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagttgaaagctccctaag

SEQ ID NO: 89039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattctgagttgaaagc

SEQ ID NO: 89040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatattctgagttgaaag

SEQ ID NO: 89041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatattctgagttgaaa

SEQ ID NO: 89042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctttaaaatattctgagt

SEQ ID NO: 89043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtctttaaaatattctgag

SEQ ID NO: 89044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtctttaaaatattctga

SEQ ID NO: 89045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagcatacattttagtctt

SEQ ID NO: 89046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctataagcatacattttagt

SEQ ID NO: 89047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctataagcatacattttag

SEQ ID NO: 89048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctataagcatacatttta

SEQ ID NO: 89049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttgctataagcatacat

SEQ ID NO: 89050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggttttgctataagcataca

SEQ ID NO: 89051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagaaggcaatgtagtctt

SEQ ID NO: 89052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggtagaaggcaatgtagt

SEQ ID NO: 89053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccacctgttggtagaaggca

SEQ ID NO: 89054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgtggcatatattgccac

SEQ ID NO: 89055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatggctgtgtgtggcata

SEQ ID NO: 89056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcaggactaaaatggctgtg

SEQ ID NO: 89057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattggcaggactaaaatgg

SEQ ID NO: 89058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtattggcaggactaaaatg

SEQ ID NO: 89059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtattggcaggactaaaat

SEQ ID NO: 89060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaactttgtattggcagg

SEQ ID NO: 89061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataaactaatgaactttgt

SEQ ID NO: 89062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagacactgaataaactaat

SEQ ID NO: 89063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagcaaggcccacatcctg

SEQ ID NO: 89064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaagcaaggcccacatcct

SEQ ID NO: 89065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataaccttgaaagcaaggc

SEQ ID NO: 89066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataaccttgaaagcaagg

SEQ ID NO: 89067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaatttatataaccttgaa

SEQ ID NO: 89068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaatttatataaccttga

SEQ ID NO: 89069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggatttaagaatttatat

SEQ ID NO: 89070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaacctgatggatttaag

SEQ ID NO: 89071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaaacctgatggatttaa

SEQ ID NO: 89072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtgtatccacatttatcaa

SEQ ID NO: 89073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggtgtgttcagtgtatccac

SEQ ID NO: 89074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacatcctcggtgtgttcag

SEQ ID NO: 89075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caacatcctcggtgtgttca

SEQ ID NO: 89076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaacatcctcggtgtgttc

SEQ ID NO: 89077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctttcaacatcctcggt

SEQ ID NO: 89078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaatctttcaacatcctc

SEQ ID NO: 89079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttattaaatctttcaacatc

SEQ ID NO: 89080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttattaaatctttcaacat

SEQ ID NO: 89081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttattaaatctttcaaca

SEQ ID NO: 89082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttattaaatctttcaac

SEQ ID NO: 89083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caatgtttttgttattaaat

SEQ ID NO: 89084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgatattccaatgtttt

SEQ ID NO: 89085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttcccatgatattccaatg

SEQ ID NO: 89086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttcccatgatattccaat

SEQ ID NO: 89087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggttcccatgatattccaa

SEQ ID NO: 89088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggttcccatgatattcc

SEQ ID NO: 89089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttggttcccatgatattc

SEQ ID NO: 89090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttggttcccatgatatt

SEQ ID NO: 89091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttggttcccatgatat

SEQ ID NO: 89092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttctttggttcccatga

SEQ ID NO: 89093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatttttctttggttccca

SEQ ID NO: 89094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatttttctttggttccc

SEQ ID NO: 89095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattatttttctttggttcc

SEQ ID NO: 89096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatcattttattatttttct

SEQ ID NO: 89097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgatcattttattatttttc

SEQ ID NO: 89098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcgatcattttattattttt

SEQ ID NO: 89099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttcgatcattttattatt

SEQ ID NO: 89100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttcgatcattttattat

SEQ ID NO: 89101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactttcgatcattttatt

SEQ ID NO: 89102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttactttcgatcattttat

SEQ ID NO: 89103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttactttcgatcatttta

SEQ ID NO: 89104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcttactttcgatcatt

SEQ ID NO: 89105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattttcttactttcgatc

SEQ ID NO: 89106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attattttcttactttcgat

SEQ ID NO: 89107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccacatttattattttctta

SEQ ID NO: 89108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccacatttattattttctt

SEQ ID NO: 89109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcacttgccacatttatta

SEQ ID NO: 89110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgcacttgccacatttatt

SEQ ID NO: 89111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgcacttgccacatttat

SEQ ID NO: 89112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatgcacttgccacattta

SEQ ID NO: 89113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacttttatgcacttgccac

SEQ ID NO: 89114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaatgattaaacttttatg

SEQ ID NO: 89115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtcaatgattaaactttt

SEQ ID NO: 89116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagggtcatcattactgtca

SEQ ID NO: 89117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtcctagagggtcatcatt

SEQ ID NO: 89118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctcagtcctagagggtcatc

SEQ ID NO: 89119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctcagtcctagagggtca

SEQ ID NO: 89120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataattctgctcagtccta

SEQ ID NO: 89121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcataattctgctcagtcct

SEQ ID NO: 89122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcataattctgctcagtcc

SEQ ID NO: 89123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgcataattctgctcagtc

SEQ ID NO: 89124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacttttgcataattctgct

SEQ ID NO: 89125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacttttgcataattctgc

SEQ ID NO: 89126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaacttttgcataattctg

SEQ ID NO: 89127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaaacttttgcataatt

SEQ ID NO: 89128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attattttaaacttttgcat

SEQ ID NO: 89129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agctcattattttaaacttt

SEQ ID NO: 89130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaagctcattattttaaa

SEQ ID NO: 89131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcctaagctcattatttt

SEQ ID NO: 89132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctattgcctaagctcatta

SEQ ID NO: 89133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggctattgcctaagctca

SEQ ID NO: 89134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctggctattgcctaagctc

SEQ ID NO: 89135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatcttgctggctattgcct

SEQ ID NO: 89136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtatcttgctggctattgcc

SEQ ID NO: 89137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgtatcttgctggctatt

SEQ ID NO: 89138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaacaatgttccttgta

SEQ ID NO: 89139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaacaatgttccttgt

SEQ ID NO: 89140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaaacaatgttccttg

SEQ ID NO: 89141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaaacaatgttcctt

SEQ ID NO: 89142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaaaacaatgttcct

SEQ ID NO: 89143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaaaaaacaatgttcc

SEQ ID NO: 89144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttttaaaaaaacaatg

SEQ ID NO: 89145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catttttttaaaaaaacaat

SEQ ID NO: 89146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatttttttaaaaaaacaa

SEQ ID NO: 89147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gagcattttcatttttttaa

SEQ ID NO: 89148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgctagagcattttcattt

SEQ ID NO: 89149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actcatgctagagcattttc

SEQ ID NO: 89150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgactcatgctagagcattt

SEQ ID NO: 89151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgaaaaatcctctgactca

SEQ ID NO: 89152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaatgaaaaatcctctgac

SEQ ID NO: 89153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagcatccgctgctaatgaa

SEQ ID NO: 89154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggagcatccgctgctaatg

SEQ ID NO: 89155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttctggagcatccgctgc

SEQ ID NO: 89156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcattaagttctggagcatc

SEQ ID NO: 89157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agcattaagttctggagcat

SEQ ID NO: 89158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagcattaagttctggagca

SEQ ID NO: 89159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actttagcattaagttctgg

SEQ ID NO: 89160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactttagcattaagttct

SEQ ID NO: 89161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcactttagcattaagttc

SEQ ID NO: 89162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcactttagcattaagtt

SEQ ID NO: 89163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctcactttagcattaagt

SEQ ID NO: 89164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcttttctcactttagcat

SEQ ID NO: 89165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgaatacctagtcttttc

SEQ ID NO: 89166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaatgaatacctagtctttt

SEQ ID NO: 89167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgaatgaatacctagtctt

SEQ ID NO: 89168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgaatgaatacctagtct

SEQ ID NO: 89169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttcttgaatgaataccta

SEQ ID NO: 89170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccttcttgaatgaatacct

SEQ ID NO: 89171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgccttcttgaatgaatacc

SEQ ID NO: 89172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattttgccttcttgaatga

SEQ ID NO: 89173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggattttgccttcttgaatg

SEQ ID NO: 89174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcttggattttgccttctt

SEQ ID NO: 89175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtgcttggattttgcctt

SEQ ID NO: 89176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttactgtgcttggattttgc

SEQ ID NO: 89177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcagcagctgttactgtgc

SEQ ID NO: 89178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcagcagctgttactgtg

SEQ ID NO: 89179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccccatcaggaatatttcat

SEQ ID NO: 89180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgccccatcaggaatattt

SEQ ID NO: 89181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaattcctgccccatcagg

SEQ ID NO: 89182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaattcctgccccatcag

SEQ ID NO: 89183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacaattcctgccccatca

SEQ ID NO: 89184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaacaattcctgccccatc

SEQ ID NO: 89185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagggcttttaacaattcct

SEQ ID NO: 89186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattaaagggcttttaacaa

SEQ ID NO: 89187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atattgaattaaagggcttt

SEQ ID NO: 89188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatattgaattaaagggctt

SEQ ID NO: 89189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatattgaattaaagggct

SEQ ID NO: 89190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttgatattgaattaaagg

SEQ ID NO: 89191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttgatattgaattaaag

SEQ ID NO: 89192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acttattttgatattgaatt

SEQ ID NO: 89193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actcacttattttgatattg

SEQ ID NO: 89194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aactcacttattttgatatt

SEQ ID NO: 89195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaactcacttattttgata

SEQ ID NO: 89196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaactcacttattttgat

SEQ ID NO: 89197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatgcatgcttcttaactc

SEQ ID NO: 89198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcatgcatgcttcttaact

SEQ ID NO: 89199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggcatgcatgcttcttaac

SEQ ID NO: 89200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagaatactttggcatgc

SEQ ID NO: 89201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaatgtccacaaatgttcc

SEQ ID NO: 89202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacaatgtccacaaatgttc

SEQ ID NO: 89203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacaatgtccacaaatgtt

SEQ ID NO: 89204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttgacaatgtccacaaa

SEQ ID NO: 89205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagtagatgtcactagttt

SEQ ID NO: 89206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgagtagatgtcactagtt

SEQ ID NO: 89207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcaaaaatcttatgagtag

SEQ ID NO: 89208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catcaaaaatcttatgagta

SEQ ID NO: 89209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacaatgtcttcatcaaaa

SEQ ID NO: 89210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaaacaatgtcttcatcaa

SEQ ID NO: 89211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatagattctcaaacaatg

SEQ ID NO: 89212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaatatagattctcaaaca

SEQ ID NO: 89213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctaatatagattctcaaac

SEQ ID NO: 89214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctaatatagattctcaaa

SEQ ID NO: 89215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttgctaatatagattctc

SEQ ID NO: 89216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttgctaatatagattct

SEQ ID NO: 89217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cccccttcctttgctaatat

SEQ ID NO: 89218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaccagattacccccttcc

SEQ ID NO: 89219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctcaaaccagattaccccct

SEQ ID NO: 89220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gactcctcaaaccagattac

SEQ ID NO: 89221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agactcctcaaaccagatta

SEQ ID NO: 89222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagactcctcaaaccagatt

SEQ ID NO: 89223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttagactcctcaaaccag

SEQ ID NO: 89224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcctttagactcctcaaac

SEQ ID NO: 89225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aataaactgttcctttagac

SEQ ID NO: 89226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactaaataaactgttcctt

SEQ ID NO: 89227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactaaataaactgttcct

SEQ ID NO: 89228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagatgaatttccactaaat

SEQ ID NO: 89229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccatctccagatgaatttcc

SEQ ID NO: 89230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accatctccagatgaatttc

SEQ ID NO: 89231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taccatctccagatgaattt

SEQ ID NO: 89232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccatagtactttaccatc

SEQ ID NO: 89233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataccatagtactttaccat

SEQ ID NO: 89234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttataccatagtactttac

SEQ ID NO: 89235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgttatttataccatagta

SEQ ID NO: 89236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaactcatgttatttata

SEQ ID NO: 89237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagtaaactcatgttattt

SEQ ID NO: 89238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttagtaaactcatgttatt

SEQ ID NO: 89239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaaggtttgttagtaaac

SEQ ID NO: 89240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaaggtttgttagtaaa

SEQ ID NO: 89241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttgcaaaaggtttgttag

SEQ ID NO: 89242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaacatgttagtttgcaaa

SEQ ID NO: 89243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagagagagcagagaaata

SEQ ID NO: 89244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttccaagagagagcagaga

SEQ ID NO: 89245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttccaagagagagcagag

SEQ ID NO: 89246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagttccaagagagagcaga

SEQ ID NO: 89247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccataatcacagcctttagt

SEQ ID NO: 89248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccataatcacagcctttag

SEQ ID NO: 89249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gataccttgccataatcaca

SEQ ID NO: 89250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctagataccttgccataatc

SEQ ID NO: 89251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtgagggttcctagatac

SEQ ID NO: 89252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagattatggtgagggttc

SEQ ID NO: 89253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcatattcccagattatgg

SEQ ID NO: 89254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcatattcccagattatg

SEQ ID NO: 89255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaatatcacatgagtttc

SEQ ID NO: 89256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacaatatcacatgagttt

SEQ ID NO: 89257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaacaatatcacatgagtt

SEQ ID NO: 89258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaacaacaacagaaagaga

SEQ ID NO: 89259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaacaacaacagaaagag

SEQ ID NO: 89260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacaacaacaacagaaaga

SEQ ID NO: 89261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacaacaacaacagaaag

SEQ ID NO: 89262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatatatttttaacaacaac

SEQ ID NO: 89263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatatatttttaacaacaa

SEQ ID NO: 89264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaatatatttttaacaaca

SEQ ID NO: 89265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctttgaatatatttttaac

SEQ ID NO: 89266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctttgaatatatttttaa

SEQ ID NO: 89267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctttgaatatattttta

SEQ ID NO: 89268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaatagccatacccttt

SEQ ID NO: 89269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaaaatagccataccctt

SEQ ID NO: 89270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccttaaaaaaatagccat

SEQ ID NO: 89271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcacccttaaaaaaatag

SEQ ID NO: 89272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattcacccttaaaaaaata

SEQ ID NO: 89273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcacacatttaattcaccct

SEQ ID NO: 89274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccccaaaatggcagaaagta

SEQ ID NO: 89275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccccaaaatggcagaaag

SEQ ID NO: 89276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaattctgccccaaaatgg

SEQ ID NO: 89277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaaattctgccccaaaat

SEQ ID NO: 89278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaggttctgaaaattctgc

SEQ ID NO: 89279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatctgtgaggttctgaaaa

SEQ ID NO: 89280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatctgtgaggttctgaaa

SEQ ID NO: 89281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatatctgtgaggttctg

SEQ ID NO: 89282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatcctatttatatctgtg

SEQ ID NO: 89283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgactccaatcctatttat

SEQ ID NO: 89284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgactccaatcctattta

SEQ ID NO: 89285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcatgactccaatcctatt

SEQ ID NO: 89286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatattcttcatgactcca

SEQ ID NO: 89287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaatattcttcatgactcc

SEQ ID NO: 89288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttggaatattcttcatga

SEQ ID NO: 89289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaatttggaatattcttc

SEQ ID NO: 89290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatctaatttggaatattc

SEQ ID NO: 89291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgattgttatctaatttgga

SEQ ID NO: 89292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatcctgtgattgttatct

SEQ ID NO: 89293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatcctgtgattgttatc

SEQ ID NO: 89294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttgtgatcctgtgattgt

SEQ ID NO: 89295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcatttgtgatcctgtgat

SEQ ID NO: 89296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattcatttgtgatcctgt

SEQ ID NO: 89297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctattcatttgtgatcctg

SEQ ID NO: 89298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctattcatttgtgatcc

SEQ ID NO: 89299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcctattcatttgtgatc

SEQ ID NO: 89300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcctattcatttgtgat

SEQ ID NO: 89301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcttcctattcatttgt

SEQ ID NO: 89302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaaggataggaattattt

SEQ ID NO: 89303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggaaggataggaattatt

SEQ ID NO: 89304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatataaatttgaggaagg

SEQ ID NO: 89305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaatataaatttgaggaa

SEQ ID NO: 89306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggaatataaatttgagga

SEQ ID NO: 89307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctggaatataaatttga

SEQ ID NO: 89308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttctggaatataaatttg

SEQ ID NO: 89309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcaaaacacttccttctgg

SEQ ID NO: 89310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcaaaacacttccttctg

SEQ ID NO: 89311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agataaagcaaatgtttagg

SEQ ID NO: 89312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgagataaagcaaatgttta

SEQ ID NO: 89313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattctgagataaagcaaat

SEQ ID NO: 89314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggattctgagataaagcaaa

SEQ ID NO: 89315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaggagtcttggattctg

SEQ ID NO: 89316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcaggagtcttggattct

SEQ ID NO: 89317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatataaatttgatcagga

SEQ ID NO: 89318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaatataaatttgatcag

SEQ ID NO: 89319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggaatataaatttgatca

SEQ ID NO: 89320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctggaatataaatttga

SEQ ID NO: 89321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attccttctggaatataaat

SEQ ID NO: 89322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattccttctggaatataaa

SEQ ID NO: 89323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattccttctggaatataa

SEQ ID NO: 89324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataattttaattccttctgg

SEQ ID NO: 89325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataattttaattccttctg

SEQ ID NO: 89326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaataataatttaataatt

SEQ ID NO: 89327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaataataatttaataat

SEQ ID NO: 89328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaatttaaaaataataat

SEQ ID NO: 89329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctaataaatttaaaaataat

SEQ ID NO: 89330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattcctaataaatttaaaa

SEQ ID NO: 89331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcaaagttatattcctaat

SEQ ID NO: 89332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggtcaaagttatattcct

SEQ ID NO: 89333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaatccaagcctcctggtc

SEQ ID NO: 89334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctcagaatccaagcctcct

SEQ ID NO: 89335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctcagaatccaagcctcc

SEQ ID NO: 89336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctcagaatccaagcctc

SEQ ID NO: 89337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttatctcagaatccaagc

SEQ ID NO: 89338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctttatctcagaatccaag

SEQ ID NO: 89339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcacttgctttatctcaga

SEQ ID NO: 89340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctatgcacttgctttatct

SEQ ID NO: 89341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctatgcacttgctttatc

SEQ ID NO: 89342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcctatgcacttgctttat

SEQ ID NO: 89343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcctatgcacttgcttta

SEQ ID NO: 89344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaaccgtttttgcctatgc

SEQ ID NO: 89345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtgaaccgtttttgccta

SEQ ID NO: 89346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgttgtgaaccgttttt

SEQ ID NO: 89347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcattgaattgttgtgaacc

SEQ ID NO: 89348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcattgaattgttgtgaac

SEQ ID NO: 89349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtcattgaattgttgtgaa

SEQ ID NO: 89350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcacctttgtcattgaatt

SEQ ID NO: 89351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaataaaagttaagcacct

SEQ ID NO: 89352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaataataaaaagaagtctg

SEQ ID NO: 89353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcagttagaataataaaaa

SEQ ID NO: 89354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaatgaacaggtcaatt

SEQ ID NO: 89355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaatgaacaggtcaat

SEQ ID NO: 89356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgaaaatatgacatatgga

SEQ ID NO: 89357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgaaaatatgacatatgg

SEQ ID NO: 89358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgaaaatatgacatatg

SEQ ID NO: 89359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattttcatgaaaatatgac

SEQ ID NO: 89360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattttcatgaaaatatga

SEQ ID NO: 89361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcattttcatgaaaatatg

SEQ ID NO: 89362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtaaattttgcattttcat

SEQ ID NO: 89363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caggtcactaagtaaatttt

SEQ ID NO: 89364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggaaactccaggtcactaa

SEQ ID NO: 89365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atggaaactccaggtcacta

SEQ ID NO: 89366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatggaaactccaggtca

SEQ ID NO: 89367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagcaaatgaaaaatggtg

SEQ ID NO: 89368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggagttacaagcaaatgaa

SEQ ID NO: 89369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccactggggagttacaagca

SEQ ID NO: 89370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccactggggagttacaagc

SEQ ID NO: 89371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccactggggagttacaag

SEQ ID NO: 89372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcccactggggagttacaa

SEQ ID NO: 89373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcaataccttttcccactg

SEQ ID NO: 89374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcccctaggcaatacctt

SEQ ID NO: 89375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggaggttaagtcccctagg

SEQ ID NO: 89376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtggaggttaagtcccctag

SEQ ID NO: 89377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacaatccttgtggaggtta

SEQ ID NO: 89378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agacaatccttgtggaggtt

SEQ ID NO: 89379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagacaatccttgtggaggt

SEQ ID NO: 89380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagacaatccttgtggagg

SEQ ID NO: 89381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttttagacaatccttgtgg

SEQ ID NO: 89382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttttagacaatccttgtg

SEQ ID NO: 89383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtttttagacaatccttg

SEQ ID NO: 89384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgtttttagacaatcctt

SEQ ID NO: 89385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccacagatatttcttgtt

SEQ ID NO: 89386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataccacagatatttcttgt

SEQ ID NO: 89387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtttataccacagatatt

SEQ ID NO: 89388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggttagtgtttataccaca

SEQ ID NO: 89389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggttagtgtttataccac

SEQ ID NO: 89390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggttagtgtttatacca

SEQ ID NO: 89391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagttttaaggttagtgttt

SEQ ID NO: 89392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccgaaaactgaagttttaag

SEQ ID NO: 89393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaccgaaaactgaagtttt

SEQ ID NO: 89394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaccgaaaactgaagttt

SEQ ID NO: 89395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagagtttgttaccgaaa

SEQ ID NO: 89396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaagagtttgttaccgaa

SEQ ID NO: 89397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaagagtttgttaccga

SEQ ID NO: 89398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgttttcagaagagttt

SEQ ID NO: 89399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaagtgttttcagaagag

SEQ ID NO: 89400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaaagtgttttcagaaga

SEQ ID NO: 89401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttaaagtgttttcagaag

SEQ ID NO: 89402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agttttgttaaagtgttttc

SEQ ID NO: 89403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcagttttgttaaagtgt

SEQ ID NO: 89404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactcagttttgttaaagtg

SEQ ID NO: 89405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactcagttttgttaaagt

SEQ ID NO: 89406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcactcagttttgttaaag

SEQ ID NO: 89407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcactcagttttgtta

SEQ ID NO: 89408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttttcactcagttttgtt

SEQ ID NO: 89409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtaaagtcacttatttttca

SEQ ID NO: 89410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtaaagtcacttatttttc

SEQ ID NO: 89411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtaaagtcacttattttt

SEQ ID NO: 89412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtaaagtcacttatttt

SEQ ID NO: 89413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttttagtaaagtcactta

SEQ ID NO: 89414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaatttttagtaaagtcac

SEQ ID NO: 89415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttaatttttagtaaagtc

SEQ ID NO: 89416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgttaatttttagtaaag

SEQ ID NO: 89417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctctgttaatttttagtaa

SEQ ID NO: 89418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctctctgttaatttttag

SEQ ID NO: 89419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaaatctcctctctctgtt

SEQ ID NO: 89420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaagcaagttcaaaaatc

SEQ ID NO: 89421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaagcaagttcaaaaat

SEQ ID NO: 89422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataaagcaagttcaaaaa

SEQ ID NO: 89423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaataaagcaagttcaa

SEQ ID NO: 89424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttaataaagcaagttca

SEQ ID NO: 89425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatttattttaataaagcaa

SEQ ID NO: 89426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agatttattttaataaagca

SEQ ID NO: 89427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatcttagatttattttaa

SEQ ID NO: 89428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatcttagatttatttta

SEQ ID NO: 89429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttagaatcttagatttatt

SEQ ID NO: 89430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatttagaatcttagattt

SEQ ID NO: 89431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactatttagaatcttagat

SEQ ID NO: 89432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctactatttagaatcttaga

SEQ ID NO: 89433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacggtcaagtagatcaatg

SEQ ID NO: 89434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcaacggtcaagtagatcaa

SEQ ID NO: 89435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcaacggtcaagtagatca

SEQ ID NO: 89436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcaacggtcaagtagatc

SEQ ID NO: 89437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttctcaacggtcaagtag

SEQ ID NO: 89438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttttctcaacggtcaagta

SEQ ID NO: 89439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcttgttttctcaacggtca

SEQ ID NO: 89440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgagtaagaaagaaaagct

SEQ ID NO: 89441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattaatgagtaagaaagaa

SEQ ID NO: 89442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtaaacaaattgaattaat

SEQ ID NO: 89443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagtaaacaaattgaattaa

SEQ ID NO: 89444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atacttgagtaaacaaattg

SEQ ID NO: 89445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatacttgagtaaacaaatt

SEQ ID NO: 89446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacagagaaggtgcttaata

SEQ ID NO: 89447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacagagaaggtgcttaat

SEQ ID NO: 89448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcacagagaaggtgcttaa

SEQ ID NO: 89449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaggctttgcacagagaag

SEQ ID NO: 89450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaggctttgcacagagaa

SEQ ID NO: 89451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaggctttgcacagaga

SEQ ID NO: 89452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatccacacagaccatttt

SEQ ID NO: 89453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagttgtaatccacacagac

SEQ ID NO: 89454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctgtagttgtaatccaca

SEQ ID NO: 89455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtgctgtagttgtaatc

SEQ ID NO: 89456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcaaacaaggattcattg

SEQ ID NO: 89457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatatgattaaatcaaacaa

SEQ ID NO: 89458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcctagatatgattaaatc

SEQ ID NO: 89459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatcctagatatgattaaa

SEQ ID NO: 89460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatcctagatatgattaa

SEQ ID NO: 89461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaatcctagatatgatta

SEQ ID NO: 89462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttctaatcctagatatg

SEQ ID NO: 89463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattttctaatcctagatat

SEQ ID NO: 89464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggacccttcattttctaat

SEQ ID NO: 89465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggacccttcattttctaa

SEQ ID NO: 89466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaatttagggacccttca

SEQ ID NO: 89467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttaatgaatttagggaccc

SEQ ID NO: 89468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctagttaatgaatttaggg

SEQ ID NO: 89469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctagctagttaatgaattt

SEQ ID NO: 89470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctagctagttaatgaatt

SEQ ID NO: 89471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgggaaagaatatccttgc

SEQ ID NO: 89472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgatgggaaagaatatcct

SEQ ID NO: 89473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagaattcctgatgggaaa

SEQ ID NO: 89474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggagaattcctgatgggaa

SEQ ID NO: 89475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaatttaggagaattcctg

SEQ ID NO: 89476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataaatatactagcaattt

SEQ ID NO: 89477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtataaatatactagcaa

SEQ ID NO: 89478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttgttgtataaatatact

SEQ ID NO: 89479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttgttgtataaatatac

SEQ ID NO: 89480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagttgttgtataaatata

SEQ ID NO: 89481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagttgttgtataaatat

SEQ ID NO: 89482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacttttgagttgttgtat

SEQ ID NO: 89483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taccagtattaaaacttttg

SEQ ID NO: 89484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataccagtattaaaactttt

SEQ ID NO: 89485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataccagtattaaaacttt

SEQ ID NO: 89486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttataccagtattaaaactt

SEQ ID NO: 89487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttataccagtattaaaac

SEQ ID NO: 89488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttataccagtattaaaa

SEQ ID NO: 89489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttataccagtattaaa

SEQ ID NO: 89490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttttataccagtattaa

SEQ ID NO: 89491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttttataccagtatta

SEQ ID NO: 89492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttttttcttttataccagta

SEQ ID NO: 89493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgttttttcttttataccag

SEQ ID NO: 89494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctgttttttcttttatac

SEQ ID NO: 89495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctgttttttcttttata

SEQ ID NO: 89496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttctgttttttcttttat

SEQ ID NO: 89497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttgttctgttttttcttt

SEQ ID NO: 89498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttgttctgttttttctt

SEQ ID NO: 89499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttgttctgttttttct

SEQ ID NO: 89500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttgttttgttctgtttt

SEQ ID NO: 89501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttgttttgttctgttt

SEQ ID NO: 89502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatttcattttgttttgtt

SEQ ID NO: 89503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagaactcccatttcatttt

SEQ ID NO: 89504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagaactcccatttcattt

SEQ ID NO: 89505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catttcaagaactcccattt

SEQ ID NO: 89506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccatttcaagaactcccatt

SEQ ID NO: 89507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacatgtgccttccatttca

SEQ ID NO: 89508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaacatgtgccttccattt

SEQ ID NO: 89509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctgaacatgtgccttcca

SEQ ID NO: 89510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actctgaacatgtgccttcc

SEQ ID NO: 89511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatgtgccttactctgaaca

SEQ ID NO: 89512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtctgaatgtgccttactct

SEQ ID NO: 89513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtctgaatgtgccttactc

SEQ ID NO: 89514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtctgaatgtgccttact

SEQ ID NO: 89515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtctgaatgtgccttac

SEQ ID NO: 89516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtttttagtctgaatgtgcc

SEQ ID NO: 89517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccccagagatctggttttt

SEQ ID NO: 89518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatacccattgtccccaga

SEQ ID NO: 89519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatacccattgtccccag

SEQ ID NO: 89520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccatacccattgtcccca

SEQ ID NO: 89521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagctttcccatacccattg

SEQ ID NO: 89522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagctttcccatacccatt

SEQ ID NO: 89523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agagagtttccagctttccc

SEQ ID NO: 89524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagagagtttccagctttc

SEQ ID NO: 89525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtagactctaagagagtttc

SEQ ID NO: 89526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tataattcgtagactctaag

SEQ ID NO: 89527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatataattcgtagactct

SEQ ID NO: 89528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaattcctatataattcgt

SEQ ID NO: 89529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaattcctatataattcg

SEQ ID NO: 89530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaattcctatataattc

SEQ ID NO: 89531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaattcctatataatt

SEQ ID NO: 89532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaattcctatataat

SEQ ID NO: 89533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgattttttaaaaattcct

SEQ ID NO: 89534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggtgattttttaaaaat

SEQ ID NO: 89535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgattcattggtgatttttt

SEQ ID NO: 89536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtctgtgattcattggtga

SEQ ID NO: 89537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtctgtgattcattggtg

SEQ ID NO: 89538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acgtttaggtctgtgattca

SEQ ID NO: 89539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgacgtttaggtctgtgatt

SEQ ID NO: 89540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actctgacgtttaggtctgt

SEQ ID NO: 89541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taactctgacgtttaggtct

SEQ ID NO: 89542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagttctaactctgacgttt

SEQ ID NO: 89543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagttctaactctgacgtt

SEQ ID NO: 89544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaatttacagttctaactc

SEQ ID NO: 89545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaatttacagttctaact

SEQ ID NO: 89546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagaaatttacagttctaa

SEQ ID NO: 89547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttagaaatttacagttcta

SEQ ID NO: 89548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttagaaatttacagttct

SEQ ID NO: 89549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatattttcttagaaattt

SEQ ID NO: 89550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctatgatattttcttagaa

SEQ ID NO: 89551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctatgatattttcttaga

SEQ ID NO: 89552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctatgatattttcttag

SEQ ID NO: 89553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccctatgatattttctta

SEQ ID NO: 89554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaagatttttccctatgata

SEQ ID NO: 89555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtctcgaagatttttccc

SEQ ID NO: 89556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgtccatgtgccaaatct

SEQ ID NO: 89557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttccatgtccatgtgccaa

SEQ ID NO: 89558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttccatgtccatgtgcca

SEQ ID NO: 89559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttccatgtccatgtgcc

SEQ ID NO: 89560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttggttccatgtccatgtgc

SEQ ID NO: 89561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accgtgcttttggttccatg

SEQ ID NO: 89562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaccgtgcttttggttcc

SEQ ID NO: 89563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgaccgtgcttttggttc

SEQ ID NO: 89564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgaccgtgcttttggtt

SEQ ID NO: 89565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgttgaccgtgcttttggt

SEQ ID NO: 89566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgttgaccgtgcttttg

SEQ ID NO: 89567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgttgaccgtgctttt

SEQ ID NO: 89568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttgttgaccgtgcttt

SEQ ID NO: 89569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttttgttgaccgtgctt

SEQ ID NO: 89570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttttgttgaccgtgct

SEQ ID NO: 89571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttcttttgttgaccgtgc

SEQ ID NO: 89572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttcttttgttgaccgtg

SEQ ID NO: 89573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttttcttttgttgaccg

SEQ ID NO: 89574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctctttttttcttttgtt

SEQ ID NO: 89575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaaaatccaattcagctct

SEQ ID NO: 89576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacaaaatccaattcagctc

SEQ ID NO: 89577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacaaaatccaattcagct

SEQ ID NO: 89578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttgacaaaatccaatt

SEQ ID NO: 89579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttgacaaaatccaat

SEQ ID NO: 89580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgcacaacagtttcaattt

SEQ ID NO: 89581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgcacaacagtttcaatt

SEQ ID NO: 89582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatgcacaacagtttcaat

SEQ ID NO: 89583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttgatgcacaacagtttca

SEQ ID NO: 89584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtagtgttctttgatgcaca

SEQ ID NO: 89585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtagtgttctttgatgca

SEQ ID NO: 89586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagtagtgttctttgatgc

SEQ ID NO: 89587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctagtagtgttctttgatg

SEQ ID NO: 89588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttctagtagtgttcttt

SEQ ID NO: 89589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactttctagtagtgttctt

SEQ ID NO: 89590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactttctagtagtgttct

SEQ ID NO: 89591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcactttctagtagtgttc

SEQ ID NO: 89592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttttcactttctagtagt

SEQ ID NO: 89593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatcatatggattgccttt

SEQ ID NO: 89594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccatcatatggattgcct

SEQ ID NO: 89595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccatcatatggattgcc

SEQ ID NO: 89596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccatcatatggattgc

SEQ ID NO: 89597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttctcccatcatatggat

SEQ ID NO: 89598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caattattttctcccatcat

SEQ ID NO: 89599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaattattttctcccatca

SEQ ID NO: 89600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagatatatgatttgcaat

SEQ ID NO: 89601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcagatatatgatttgcaa

SEQ ID NO: 89602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcccttatcagatatatga

SEQ ID NO: 89603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaatgttaatcccttatca

SEQ ID NO: 89604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catattgccaatgttaatcc

SEQ ID NO: 89605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatattgccaatgttaatc

SEQ ID NO: 89606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatattgccaatgttaat

SEQ ID NO: 89607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacatattgccaatgttaa

SEQ ID NO: 89608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttacatattgccaatgtta

SEQ ID NO: 89609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggagtaggaattttttaca

SEQ ID NO: 89610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgaggagtaggaatttttt

SEQ ID NO: 89611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttgaggagtaggaattttt

SEQ ID NO: 89612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttgaggagtaggaatttt

SEQ ID NO: 89613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttgaggagtaggaattt

SEQ ID NO: 89614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttgaggagtaggaatt

SEQ ID NO: 89615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttgttgaggagtagga

SEQ ID NO: 89616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttgttgaggagtagg

SEQ ID NO: 89617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttattttttgttgaggagt

SEQ ID NO: 89618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttattttttgttgaggag

SEQ ID NO: 89619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgtttattttttgttgag

SEQ ID NO: 89620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atctgcttgtttattttttg

SEQ ID NO: 89621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatctgcttgtttatttttt

SEQ ID NO: 89622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taatctgcttgtttattttt

SEQ ID NO: 89623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaatctgcttgtttatttt

SEQ ID NO: 89624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttaatctgcttgttta

SEQ ID NO: 89625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcatttttaatctgcttgt

SEQ ID NO: 89626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcatttttaatctgcttg

SEQ ID NO: 89627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgttcatttttaatctgctt

SEQ ID NO: 89628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatcctttgttcattttta

SEQ ID NO: 89629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatcctttgttcattttt

SEQ ID NO: 89630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaatcctttgttcatttt

SEQ ID NO: 89631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaaatcctttgttcattt

SEQ ID NO: 89632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaaatgtcttttcaaatc

SEQ ID NO: 89633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaaatgtcttttcaaat

SEQ ID NO: 89634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaaaaatgtcttttcaaa

SEQ ID NO: 89635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttggaaaaatgtcttttca

SEQ ID NO: 89636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttggaaaaatgtcttttc

SEQ ID NO: 89637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttggaaaaatgtctttt

SEQ ID NO: 89638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttctttggaaaaatgtc

SEQ ID NO: 89639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attgactttctttggaaaaa

SEQ ID NO: 89640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatgtactgattgactttc

SEQ ID NO: 89641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccatgtactgattgacttt

SEQ ID NO: 89642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcatcttcccatgtactga

SEQ ID NO: 89643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaatgatcggtgatgttg

SEQ ID NO: 89644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaaatgatcggtgatgtt

SEQ ID NO: 89645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catttcccaaatgatcggtg

SEQ ID NO: 89646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatttcccaaatgatcggt

SEQ ID NO: 89647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttgcatttcccaaatgat

SEQ ID NO: 89648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttgcatttcccaaatga

SEQ ID NO: 89649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatttgcatttcccaaatg

SEQ ID NO: 89650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggttttgatttgcatttcc

SEQ ID NO: 89651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtggttttgatttgcatt

SEQ ID NO: 89652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtggttttgatttgcat

SEQ ID NO: 89653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtggttttgatttgca

SEQ ID NO: 89654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaataaccatccgaccaa

SEQ ID NO: 89655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacaataaccatccgacca

SEQ ID NO: 89656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaacaataaccatccgacc

SEQ ID NO: 89657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaacaataaccatccgac

SEQ ID NO: 89658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaacaataaccatccga

SEQ ID NO: 89659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaacaataaccatccg

SEQ ID NO: 89660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaaacaataaccatcc

SEQ ID NO: 89661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaaacaataaccatc

SEQ ID NO: 89662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttaaacaataaccat

SEQ ID NO: 89663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttaaacaataacca

SEQ ID NO: 89664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttaaacaataacc

SEQ ID NO: 89665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttaaacaataac

SEQ ID NO: 89666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttttttttttttaaacaat

SEQ ID NO: 89667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttttttttttttaaacaa

SEQ ID NO: 89668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttttttttttttaaaca

SEQ ID NO: 89669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccttttttttttttaaac

SEQ ID NO: 89670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttccttttttttttttaa

SEQ ID NO: 89671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttcctttttttttttta

SEQ ID NO: 89672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaatgtttcttttcctttt

SEQ ID NO: 89673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcaatgtttcttttccttt

SEQ ID NO: 89674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacacccttgtcaatgtttc

SEQ ID NO: 89675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccacacccttgtcaatgtt

SEQ ID NO: 89676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccacacccttgtcaatgt

SEQ ID NO: 89677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatttctccacacccttgt

SEQ ID NO: 89678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcagcaatgcacaagggtta

SEQ ID NO: 89679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatcagcaatgcacaaggg

SEQ ID NO: 89680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattcctatcagcaatgcac

SEQ ID NO: 89681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattcctatcagcaatgca

SEQ ID NO: 89682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatattcctatcagcaatgc

SEQ ID NO: 89683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttatattcctatcagcaa

SEQ ID NO: 89684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactattttatattcctatc

SEQ ID NO: 89685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacagcagctgcactatttt

SEQ ID NO: 89686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacagcagctgcactattt

SEQ ID NO: 89687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccacagcagctgcactatt

SEQ ID NO: 89688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaaccaccacagtgtttt

SEQ ID NO: 89689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggaaccaccacagtgttt

SEQ ID NO: 89690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaggaaccaccacagtgtt

SEQ ID NO: 89691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaggaaccaccacagtgt

SEQ ID NO: 89692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgaggaaccaccacagtg

SEQ ID NO: 89693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttttgaggaaccaccac

SEQ ID NO: 89694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattttttgaggaaccacca

SEQ ID NO: 89695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttaattttttgaggaacca

SEQ ID NO: 89696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttaattttttgaggaac

SEQ ID NO: 89697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttaattttttgaggaa

SEQ ID NO: 89698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatcatgtgatatttctgtt

SEQ ID NO: 89699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggatcatgtgatatttct

SEQ ID NO: 89700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtagaattgctggatcat

SEQ ID NO: 89701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggatgtataccctaaagtag

SEQ ID NO: 89702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggatgtataccctaaagta

SEQ ID NO: 89703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttaggatgtataccctaaa

SEQ ID NO: 89704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attgtttaggatgtataccc

SEQ ID NO: 89705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaattgtttaggatgtata

SEQ ID NO: 89706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattaattgtttaggatgta

SEQ ID NO: 89707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctattaattgtttaggatgt

SEQ ID NO: 89708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgcgtcccttctattaat

SEQ ID NO: 89709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtacagataactacatgc

SEQ ID NO: 89710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaacattggtgtacagata

SEQ ID NO: 89711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctatgaacattggtgtacag

SEQ ID NO: 89712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgctgctatgaacattggt

SEQ ID NO: 89713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgattagtgctgctatgaac

SEQ ID NO: 89714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgtgattagtgctgctatg

SEQ ID NO: 89715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctactgtgattagtgctgc

SEQ ID NO: 89716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggctactgtgattagtgctg

SEQ ID NO: 89717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggctactgtgattagtgct

SEQ ID NO: 89718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggctactgtgattagtgc

SEQ ID NO: 89719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttggctactgtgattagtg

SEQ ID NO: 89720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttttggctactgtgatt

SEQ ID NO: 89721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactttttggctactgtgat

SEQ ID NO: 89722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactttttggctactgtga

SEQ ID NO: 89723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcactttttggctactg

SEQ ID NO: 89724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggttgttttcactttttggc

SEQ ID NO: 89725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggttgttttcactttttgg

SEQ ID NO: 89726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagacatttgggttgtttt

SEQ ID NO: 89727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgatagacatttgggttgt

SEQ ID NO: 89728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atctgttgatagacatttgg

SEQ ID NO: 89729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcatctgttgatagacatt

SEQ ID NO: 89730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgttcatctgttgataga

SEQ ID NO: 89731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgttcatctgttgatag

SEQ ID NO: 89732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttatctgttcatctgttga

SEQ ID NO: 89733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttatctgttcatctgttg

SEQ ID NO: 89734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtttatctgttcatctgtt

SEQ ID NO: 89735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacacattttgtttatctgt

SEQ ID NO: 89736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacacattttgtttatctg

SEQ ID NO: 89737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcatttatacacattttgt

SEQ ID NO: 89738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtgcatttatacacattt

SEQ ID NO: 89739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtgcatttatacacatt

SEQ ID NO: 89740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtgcatttatacacat

SEQ ID NO: 89741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtagtattttattgtgcat

SEQ ID NO: 89742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggctgtgtagtattttatt

SEQ ID NO: 89743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggctgtgtagtattttat

SEQ ID NO: 89744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaggctgtgtagtatttta

SEQ ID NO: 89745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaggctgtgtagtatttt

SEQ ID NO: 89746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atttttaaggctgtgtagta

SEQ ID NO: 89747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcatttttaaggctgtgta

SEQ ID NO: 89748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcatttttaaggctgtgt

SEQ ID NO: 89749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattcatttttaaggctgtg

SEQ ID NO: 89750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atccgggtcgtagcatatat

SEQ ID NO: 89751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggtgttcatccgggtcgt

SEQ ID NO: 89752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaggtgttcatccgggtcg

SEQ ID NO: 89753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaggtgttcatccgggtc

SEQ ID NO: 89754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcataatgttttcaaggtgt

SEQ ID NO: 89755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcataatgttttcaaggtg

SEQ ID NO: 89756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttagcataatgttttcaa

SEQ ID NO: 89757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacttagcataatgttttca

SEQ ID NO: 89758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcacttagcataatgttt

SEQ ID NO: 89759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttcacttagcataatgtt

SEQ ID NO: 89760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttatttcacttagcataa

SEQ ID NO: 89761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtctggcttatttcactt

SEQ ID NO: 89762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgtctggcttatttcact

SEQ ID NO: 89763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgtctggcttatttcac

SEQ ID NO: 89764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcatgtctggcttatttca

SEQ ID NO: 89765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttttcatgtctggcttat

SEQ ID NO: 89766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcttttcatgtctggctta

SEQ ID NO: 89767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagcatttgtcttttcatgt

SEQ ID NO: 89768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgtaagtggaaccctatag

SEQ ID NO: 89769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtacctcatgtaagtggaa

SEQ ID NO: 89770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggtacctcatgtaagtgg

SEQ ID NO: 89771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctaggtacctcatgtaag

SEQ ID NO: 89772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaatgtgactattctaggt

SEQ ID NO: 89773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgaatgtgactattctag

SEQ ID NO: 89774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctatgaatgtgactattct

SEQ ID NO: 89775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctatgaatgtgactattc

SEQ ID NO: 89776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctatgaatgtgactatt

SEQ ID NO: 89777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttctctatgaatgtgact

SEQ ID NO: 89778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tactttctctatgaatgtga

SEQ ID NO: 89779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctactttctctatgaatg

SEQ ID NO: 89780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcacccagtaaccactattc

SEQ ID NO: 89781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctatcacccagtaaccac

SEQ ID NO: 89782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccctatcacccagtaacca

SEQ ID NO: 89783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcccctatcacccagtaac

SEQ ID NO: 89784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttcccctatcacccagta

SEQ ID NO: 89785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctcttcccctatcaccca

SEQ ID NO: 89786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacactcctctcttccccta

SEQ ID NO: 89787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaatgactccacactcct

SEQ ID NO: 89788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaaacaatgactccacact

SEQ ID NO: 89789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggtaactattaaacaatgac

SEQ ID NO: 89790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaacaaaaactcggtaact

SEQ ID NO: 89791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcattccaaacaaaaactc

SEQ ID NO: 89792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcattccaaacaaaaact

SEQ ID NO: 89793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatcattccaaacaaaaac

SEQ ID NO: 89794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaacattttcatcattcca

SEQ ID NO: 89795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagaacattttcatcattcc

SEQ ID NO: 89796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacacgatcaccaccatcca

SEQ ID NO: 89797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgttgtacacgatcaccac

SEQ ID NO: 89798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcacattcatgttgtacac

SEQ ID NO: 89799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaggtattaagcacattcat

SEQ ID NO: 89800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaggtattaagcacattca

SEQ ID NO: 89801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgtacagtttagaggta

SEQ ID NO: 89802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatgtacagtttagaggt

SEQ ID NO: 89803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accatttcaaatgtacagtt

SEQ ID NO: 89804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaccatttcaaatgtacagt

SEQ ID NO: 89805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaccatttcaaatgtacag

SEQ ID NO: 89806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccattttaaccatttcaaat

SEQ ID NO: 89807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accattttaaccatttcaaa

SEQ ID NO: 89808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaaaatatatataacaaaa

SEQ ID NO: 89809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaaaatatatataacaaa

SEQ ID NO: 89810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtaaaatatatataacaa

SEQ ID NO: 89811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattttggtaaaatatatat

SEQ ID NO: 89812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattttggtaaaatatata

SEQ ID NO: 89813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatttatattttggtaaa

SEQ ID NO: 89814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatttatattttggtaa

SEQ ID NO: 89815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgaatttaaaaatttatat

SEQ ID NO: 89816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaacacgctagtgaattta

SEQ ID NO: 89817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cggatctcaaaacacgctag

SEQ ID NO: 89818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acggatctcaaaacacgcta

SEQ ID NO: 89819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttacggatctcaaaacac

SEQ ID NO: 89820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgccttacggatctcaaaac

SEQ ID NO: 89821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgccttacggatctcaaaa

SEQ ID NO: 89822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgccttacggatctcaaa

SEQ ID NO: 89823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctgccttacggatctca

SEQ ID NO: 89824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actctttctgccttacggat

SEQ ID NO: 89825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgactctttctgccttacg

SEQ ID NO: 89826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgactctttctgccttac

SEQ ID NO: 89827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttactgactctttctgcctt

SEQ ID NO: 89828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttactgactctttctgcc

SEQ ID NO: 89829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttctcttactgactctttct

SEQ ID NO: 89830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttctcttactgactctttc

SEQ ID NO: 89831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttctcttactgactcttt

SEQ ID NO: 89832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgattttgttctcttactga

SEQ ID NO: 89833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtgattttgttctcttac

SEQ ID NO: 89834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgctgtgattttgttctc

SEQ ID NO: 89835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaactgctgtgattttgtt

SEQ ID NO: 89836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accggttgctaactgctgtg

SEQ ID NO: 89837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagggttgaccggttgcta

SEQ ID NO: 89838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcaaaacagataccaaggag

SEQ ID NO: 89839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctagcaaaacagataccaa

SEQ ID NO: 89840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgcctagcaaaacagatac

SEQ ID NO: 89841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catagatataaatgactact

SEQ ID NO: 89842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgaaatagtggtactgcat

SEQ ID NO: 89843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcatgaaatagtggtactgc

SEQ ID NO: 89844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcatgaaatagtggtactg

SEQ ID NO: 89845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctcatgaaatagtggta

SEQ ID NO: 89846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgattatttctcatgaaa

SEQ ID NO: 89847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttatatgattatttctcatg

SEQ ID NO: 89848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attatatgattatttctcat

SEQ ID NO: 89849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtttattatatgattatt

SEQ ID NO: 89850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgtttattatatgattat

SEQ ID NO: 89851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatgtttattatatgatta

SEQ ID NO: 89852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatcaattttgatgtttatt

SEQ ID NO: 89853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgatcaattttgatgtttat

SEQ ID NO: 89854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatatttcgatcaattttga

SEQ ID NO: 89855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatatttcgatcaattttg

SEQ ID NO: 89856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatatttcgatcaatttt

SEQ ID NO: 89857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggtgggagtacagtaata

SEQ ID NO: 89858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatggtgggagtacagtaat

SEQ ID NO: 89859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaacttaatggtgggagta

SEQ ID NO: 89860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaacttaatggtgggagt

SEQ ID NO: 89861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaacttaatggtgggag

SEQ ID NO: 89862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cattttggaaacttaatggt

SEQ ID NO: 89863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcattttggaaacttaatgg

SEQ ID NO: 89864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtttgcattttggaaac

SEQ ID NO: 89865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtttgcattttggaaa

SEQ ID NO: 89866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatgtttgcattttggaa

SEQ ID NO: 89867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagtaactttaaatgtttg

SEQ ID NO: 89868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattgagagtaactttaaa

SEQ ID NO: 89869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataagacaaagattacaatt

SEQ ID NO: 89870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gggcagggggcagggctaat

SEQ ID NO: 89871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggggcagggggcagggctaa

SEQ ID NO: 89872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttggggcagggggcagggc

SEQ ID NO: 89873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatttggggcagggggcag

SEQ ID NO: 89874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actatttggggcagggggca

SEQ ID NO: 89875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttactatttggggcaggggg

SEQ ID NO: 89876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacctcttactatttgggg

SEQ ID NO: 89877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaacctcttactatttggg

SEQ ID NO: 89878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggaacctcttactatttg

SEQ ID NO: 89879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattcttggaacctcttact

SEQ ID NO: 89880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatggattggattcttgga

SEQ ID NO: 89881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctgtaatggattggattct

SEQ ID NO: 89882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtctgtaatggattggat

SEQ ID NO: 89883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgtctgtaatggattgga

SEQ ID NO: 89884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctgtctgtaatggattg

SEQ ID NO: 89885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttcctgtctgtaatggat

SEQ ID NO: 89886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattctcttcctgtctgtaa

SEQ ID NO: 89887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgtcctatattctcttcc

SEQ ID NO: 89888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatgtcctatattctcttc

SEQ ID NO: 89889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttaaatgtcctatattc

SEQ ID NO: 89890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttaaatgtcctatatt

SEQ ID NO: 89891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatatgtaaatgtattta

SEQ ID NO: 89892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtatatgtaaatgtattt

SEQ ID NO: 89893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatgtatatgtaaatgta

SEQ ID NO: 89894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatttatgtatatgtaaat

SEQ ID NO: 89895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actatttatgtatatgtaaa

SEQ ID NO: 89896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttactatttatgtatatg

SEQ ID NO: 89897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtactgatttactatttat

SEQ ID NO: 89898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtactgatttactattta

SEQ ID NO: 89899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatgtaaatgtatatgtaca

SEQ ID NO: 89900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatgtaaatgtatatgtac

SEQ ID NO: 89901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgatttagatgtaaatgtat

SEQ ID NO: 89902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgatttagatgtaaatgta

SEQ ID NO: 89903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgatttagatgtaaatgt

SEQ ID NO: 89904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgatttagatgtaaatg

SEQ ID NO: 89905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgtgatttagatgtaaat

SEQ ID NO: 89906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgtgatttagatgtaaa

SEQ ID NO: 89907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttgtgatttagatgtaa

SEQ ID NO: 89908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctttttttgtgatttagat

SEQ ID NO: 89909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctttttttgtgatttaga

SEQ ID NO: 89910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtctttttttgtgatttag

SEQ ID NO: 89911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtctttttttgtgattta

SEQ ID NO: 89912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacaaaaataatgtttttgt

SEQ ID NO: 89913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatacaaaaataatgttttt

SEQ ID NO: 89914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatacaaaaataatgtttt

SEQ ID NO: 89915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttctatacaaaaataatg

SEQ ID NO: 89916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatttctatacaaaaataa

SEQ ID NO: 89917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatttctatacaaaaata

SEQ ID NO: 89918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaagtttctaatttctata

SEQ ID NO: 89919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaagtttctaatttctat

SEQ ID NO: 89920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacatgggtaacataaaacc

SEQ ID NO: 89921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggacatgggtaacataaaa

SEQ ID NO: 89922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggacatgggtaacataaa

SEQ ID NO: 89923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctggacatgggtaacataa

SEQ ID NO: 89924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctggacatgggtaacat

SEQ ID NO: 89925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatctctttctggacatggg

SEQ ID NO: 89926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actggatctctttctggaca

SEQ ID NO: 89927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactggatctctttctggac

SEQ ID NO: 89928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactggatctctttctgga

SEQ ID NO: 89929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaactggatctctttctgg

SEQ ID NO: 89930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaactggatctctttctg

SEQ ID NO: 89931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttaactggatctctttct

SEQ ID NO: 89932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttttaactggatctcttt

SEQ ID NO: 89933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagggatgagtgtgctct

SEQ ID NO: 89934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaagggatgagtgtgctc

SEQ ID NO: 89935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaaagggatgagtgtgct

SEQ ID NO: 89936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccagcatgggtacaactttg

SEQ ID NO: 89937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattaccagcatgggtaca

SEQ ID NO: 89938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgtgataaaccaatgctaaa

SEQ ID NO: 89939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgtcgagggctgcgtgataa

SEQ ID NO: 89940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acctgcgtcgagggctgcgt

SEQ ID NO: 89941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaacctgcgtcgagggctg

SEQ ID NO: 89942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagggattactaacctgcgt

SEQ ID NO: 89943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagggattactaacctgcg

SEQ ID NO: 89944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagggattactaacctgc

SEQ ID NO: 89945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttgtagggattactaac

SEQ ID NO: 89946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattttgtagggattactaa

SEQ ID NO: 89947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgattttgtagggattact

SEQ ID NO: 89948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttgattttgtagggattac

SEQ ID NO: 89949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttgattttgtagggatta

SEQ ID NO: 89950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttgattttgtagggatt

SEQ ID NO: 89951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagcagaagatgagggttt

SEQ ID NO: 89952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatacagacagcaagattg

SEQ ID NO: 89953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggagaagcaagaaaaccag

SEQ ID NO: 89954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggagaagcaagaaaacca

SEQ ID NO: 89955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtatttaaggagaagcaa

SEQ ID NO: 89956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgtatttaaggagaagca

SEQ ID NO: 89957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggcatatttgatgtattta

SEQ ID NO: 89958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaagccctaaggcatatt

SEQ ID NO: 89959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcacaaaaaacagcaattg

SEQ ID NO: 89960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagtcacaaaaaacagcaat

SEQ ID NO: 89961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaatcattctagtcacaa

SEQ ID NO: 89962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacaactgaagaatcattct

SEQ ID NO: 89963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctaaacaactgaagaatca

SEQ ID NO: 89964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agggagctagctaaacaact

SEQ ID NO: 89965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agtagagacatgaagtaaat

SEQ ID NO: 89966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagtagagacatgaagtaaa

SEQ ID NO: 89967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacagggtatttgagtagag

SEQ ID NO: 89968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atacagggtatttgagtaga

SEQ ID NO: 89969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatacagggtatttgagtag

SEQ ID NO: 89970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaaattttatacagggtat

SEQ ID NO: 89971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtggtctgaaaaatttta

SEQ ID NO: 89972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtggtctgaaaaatttt

SEQ ID NO: 89973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaagtggtctgaaaaat

SEQ ID NO: 89974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagaaggaggtattattta

SEQ ID NO: 89975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaaaaacaataaaacagga

SEQ ID NO: 89976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taccataagatatgctgtga

SEQ ID NO: 89977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccatcattgtaccataaga

SEQ ID NO: 89978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gccactatccatcattgtac

SEQ ID NO: 89979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagataatgaagagataaa

SEQ ID NO: 89980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagagataatgaagagataa

SEQ ID NO: 89981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagagataatgaagagata

SEQ ID NO: 89982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagacatcagatatagcaat

SEQ ID NO: 89983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtagacatcagatatagc

SEQ ID NO: 89984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgtagacatcagatatag

SEQ ID NO: 89985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgtagacatcagatata

SEQ ID NO: 89986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ataaagttttattgtagaca

SEQ ID NO: 89987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cataaagttttattgtagac

SEQ ID NO: 89988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcataaagttttattgtag

SEQ ID NO: 89989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcataaagttttattgta

SEQ ID NO: 89990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcttcataaagttttatt

SEQ ID NO: 89991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttcttcataaagttttat

SEQ ID NO: 89992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccttcttcataaagtttt

SEQ ID NO: 89993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttccttcttcataaagtt

SEQ ID NO: 89994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctctcttccttcttcataa

SEQ ID NO: 89995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctctcttccttcttcata

SEQ ID NO: 89996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccctctcttccttcttcat

SEQ ID NO: 89997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccctctcttccttcttca

SEQ ID NO: 89998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccctctcttccttcttc

SEQ ID NO: 89999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttccctctcttccttctt

SEQ ID NO: 90000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttccctctcttccttc

SEQ ID NO: 90001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttttccctctcttcctt

SEQ ID NO: 90002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcttttttccctctcttcct

SEQ ID NO: 90003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcttttttccctctcttc

SEQ ID NO: 90004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctctttcttttttccctct

SEQ ID NO: 90005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctctttcttttttccctc

SEQ ID NO: 90006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccctctttcttttttcc

SEQ ID NO: 90007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttccctctttcttttttc

SEQ ID NO: 90008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttccctctttctttttt

SEQ ID NO: 90009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttccttccctctttctttt

SEQ ID NO: 90010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctttccttccctctttcttt

SEQ ID NO: 90011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctttccttccctctttc

SEQ ID NO: 90012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagcaattccttctttcct

SEQ ID NO: 90013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaagcaattccttctttcc

SEQ ID NO: 90014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaatttaaaagcaattcctt

SEQ ID NO: 90015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggaatttaaaagcaattc

SEQ ID NO: 90016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctggaatttaaaagcaatt

SEQ ID NO: 90017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcctggaatttaaaagcaa

SEQ ID NO: 90018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tactcttcctggaatttaaa

SEQ ID NO: 90019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atactcttcctggaatttaa

SEQ ID NO: 90020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcatttatactcttcctgg

SEQ ID NO: 90021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcagcatttatactcttcct

SEQ ID NO: 90022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctcagcatttatactctt

SEQ ID NO: 90023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actcctctcagcatttatac

SEQ ID NO: 90024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaacctcactcctctcagc

SEQ ID NO: 90025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagaactcacaacctcact

SEQ ID NO: 90026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caggccagttccaagaactc

SEQ ID NO: 90027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtccctccaggccagttcc

SEQ ID NO: 90028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgagtccctccaggccagt

SEQ ID NO: 90029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagagatcccaagggcagt

SEQ ID NO: 90030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagggagggaagacctggca

SEQ ID NO: 90031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagggagggaagacctggc

SEQ ID NO: 90032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtttgtagggagggaaga

SEQ ID NO: 90033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgccattgaggtttgtagg

SEQ ID NO: 90034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtattggtgccattgaggtt

SEQ ID NO: 90035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcatccaagttggtattggt

SEQ ID NO: 90036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaaatgtgtaggtcaggag

SEQ ID NO: 90037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcctccaaaatgtgtaggtc

SEQ ID NO: 90038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttggcctccaaaatgtgta

SEQ ID NO: 90039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatccggtctagttggcctc

SEQ ID NO: 90040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atcattagatccggtctagt

SEQ ID NO: 90041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggattaatcattagatccg

SEQ ID NO: 90042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcctagggattaatcattag

SEQ ID NO: 90043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcctagggattaatcatta

SEQ ID NO: 90044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcttagcctagggattaatc

SEQ ID NO: 90045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcttagcctagggattaat

SEQ ID NO: 90046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttatcttagcctagggat

SEQ ID NO: 90047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caactgatttatcttagcct

SEQ ID NO: 90048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaactgatttatcttagcc

SEQ ID NO: 90049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatttccaactgatttatc

SEQ ID NO: 90050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagctgaaatttccaactga

SEQ ID NO: 90051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcagataagaaaaaacaaag

SEQ ID NO: 90052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaggtagactggcagataa

SEQ ID NO: 90053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacaggtagactggcagata

SEQ ID NO: 90054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acagtgacagatatgcttaa

SEQ ID NO: 90055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gacagtgacagatatgctta

SEQ ID NO: 90056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgacagtgacagatatgctt

SEQ ID NO: 90057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgacagtgacagatatgct

SEQ ID NO: 90058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtgaaataagtaaagggac

SEQ ID NO: 90059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagagacatgctaagtgaa

SEQ ID NO: 90060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgacagcatgcatggaccta

SEQ ID NO: 90061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgacagcatgcatggacct

SEQ ID NO: 90062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttgtgacagcatgcatgga

SEQ ID NO: 90063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatttgtgacagcatgcat

SEQ ID NO: 90064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actatttgtgacagcatgca

SEQ ID NO: 90065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaagaaggaaatcttac

SEQ ID NO: 90066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaaaaagaaggaaatctta

SEQ ID NO: 90067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gccttaaaaaaagaaggaaa

SEQ ID NO: 90068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctagccttaaaaaaagaag

SEQ ID NO: 90069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatataaaatagaatattat

SEQ ID NO: 90070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaatagcaaaaatatgaaa

SEQ ID NO: 90071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcacaatagcaaaaatatg

SEQ ID NO: 90072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagcattattcacaatagca

SEQ ID NO: 90073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgcagcattattcacaata

SEQ ID NO: 90074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgcagcattattcacaat

SEQ ID NO: 90075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtttactgcagcattattc

SEQ ID NO: 90076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtgtttactgcagcattat

SEQ ID NO: 90077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtgtttactgcagcatta

SEQ ID NO: 90078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagagatatatgcacttct

SEQ ID NO: 90079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatcagaatctcaaagaga

SEQ ID NO: 90080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccatatgatccagcaattga

SEQ ID NO: 90081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatagaactaccatatga

SEQ ID NO: 90082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaaaaattaaaaatagaact

SEQ ID NO: 90083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcaaaaaattaaaaataga

SEQ ID NO: 90084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggaaaataatatggaagtt

SEQ ID NO: 90085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctatggaaaataatatggaa

SEQ ID NO: 90086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgggaatgtataatagtgt

SEQ ID NO: 90087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttggtgggaatgtataatag

SEQ ID NO: 90088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccactgttggtgggaatgt

SEQ ID NO: 90089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatgtgaagaaaatgaaa

SEQ ID NO: 90090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgagaatgtgaagaaaatg

SEQ ID NO: 90091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaaaagtgaaaggtgttg

SEQ ID NO: 90092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttataaaaaagtgaaaggtg

SEQ ID NO: 90093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agatggctgttataaaaaag

SEQ ID NO: 90094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaagatggctgttataaaa

SEQ ID NO: 90095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acacctgttaagatggctgt

SEQ ID NO: 90096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatgagataatcatctcac

SEQ ID NO: 90097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagcactgcaatgagataa

SEQ ID NO: 90098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcagcactgcaatgagata

SEQ ID NO: 90099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcagcactgcaatgagat

SEQ ID NO: 90100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggttttatcagcactgcaa

SEQ ID NO: 90101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtggttaaggttttatcag

SEQ ID NO: 90102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactaagtggttaaggtttt

SEQ ID NO: 90103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagactaagtggttaaggtt

SEQ ID NO: 90104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctctagactaagtggtta

SEQ ID NO: 90105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcctctagactaagtggtt

SEQ ID NO: 90106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtagcttatcctctagacta

SEQ ID NO: 90107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggattggtagcttatcctc

SEQ ID NO: 90108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggattggtagcttatcct

SEQ ID NO: 90109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgatttgtggattggtagc

SEQ ID NO: 90110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgatttgtggattggtag

SEQ ID NO: 90111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtgatttgtggattggta

SEQ ID NO: 90112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttagtgatttgtggattg

SEQ ID NO: 90113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatctattttagtgatttgt

SEQ ID NO: 90114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatacgtctcaatctattt

SEQ ID NO: 90115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgatacgtctcaatctat

SEQ ID NO: 90116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttctatgatacgtctcaa

SEQ ID NO: 90117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagttctatgatacgtctca

SEQ ID NO: 90118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcccttgagttctatgatac

SEQ ID NO: 90119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcccttgagttctatgata

SEQ ID NO: 90120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggatataaaaaccatgggaa

SEQ ID NO: 90121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggatataaaaaccatggga

SEQ ID NO: 90122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggatataaaaaccatggg

SEQ ID NO: 90123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tactttgggatataaaaacc

SEQ ID NO: 90124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatactgtactttgggatat

SEQ ID NO: 90125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agatactgtactttgggata

SEQ ID NO: 90126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccacttagatactgtactt

SEQ ID NO: 90127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttatccacttagatactgta

SEQ ID NO: 90128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatctattatccacttag

SEQ ID NO: 90129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatctattatccactta

SEQ ID NO: 90130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatatctattatccactt

SEQ ID NO: 90131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatatctattatccact

SEQ ID NO: 90132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaatatctattatccac

SEQ ID NO: 90133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaaatatctattatcca

SEQ ID NO: 90134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catgcaatttttttaaatat

SEQ ID NO: 90135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatgcaatttttttaaata

SEQ ID NO: 90136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcatgcaatttttttaaat

SEQ ID NO: 90137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcatgcaatttttttaaa

SEQ ID NO: 90138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taataatttttgcatgcaat

SEQ ID NO: 90139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataataatttttgcatgcaa

SEQ ID NO: 90140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttataataatttttgca

SEQ ID NO: 90141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cattatgtttataataattt

SEQ ID NO: 90142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acattatgtttataataatt

SEQ ID NO: 90143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacattatgtttataataat

SEQ ID NO: 90144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttacattatgtttataat

SEQ ID NO: 90145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttacattatgtttataa

SEQ ID NO: 90146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttattttacattatgttt

SEQ ID NO: 90147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaactaatttattttaca

SEQ ID NO: 90148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaaactaatttattttac

SEQ ID NO: 90149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaaactaatttatttta

SEQ ID NO: 90150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaacagttttggaaaactaa

SEQ ID NO: 90151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaacagttttggaaaacta

SEQ ID NO: 90152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaacagttttggaaaact

SEQ ID NO: 90153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggttttaaaacagttttg

SEQ ID NO: 90154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagggttttaaaacagtttt

SEQ ID NO: 90155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagggttttaaaacagttt

SEQ ID NO: 90156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaagggttttaaaacagtt

SEQ ID NO: 90157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttttaagggttttaaaac

SEQ ID NO: 90158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatcagtaatgcaagaagt

SEQ ID NO: 90159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctaacatcagtaatgcaag

SEQ ID NO: 90160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattgtctaacatcagtaat

SEQ ID NO: 90161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtcagttaaattgtctaac

SEQ ID NO: 90162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaagtcagttaaattgtc

SEQ ID NO: 90163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aattatctaagtcagttaaa

SEQ ID NO: 90164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcatgaagactcaattatct

SEQ ID NO: 90165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgtcatgaagactcaatta

SEQ ID NO: 90166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attgtcatgaagactcaatt

SEQ ID NO: 90167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatcacagtacttattgtca

SEQ ID NO: 90168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atacacacaaatgaaaccta

SEQ ID NO: 90169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagcatcacaaattgataca

SEQ ID NO: 90170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agagcatcacaaattgatac

SEQ ID NO: 90171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggagtacaaatatttaga

SEQ ID NO: 90172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattggaggagtacaaatat

SEQ ID NO: 90173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatattggaggagtacaaat

SEQ ID NO: 90174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatattctatattggaggag

SEQ ID NO: 90175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agatattctatattggagga

SEQ ID NO: 90176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaataaaaatttagatat

SEQ ID NO: 90177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaaataaaaatttagata

SEQ ID NO: 90178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatcttggaaaataaaaa

SEQ ID NO: 90179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatcttggaaaataaaa

SEQ ID NO: 90180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagtatttatatatcttgg

SEQ ID NO: 90181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attggaagtatttatatatc

SEQ ID NO: 90182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgcaggataagatgatggtg

SEQ ID NO: 90183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgcaggataagatgatggt

SEQ ID NO: 90184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcagatggagaagtatgaaa

SEQ ID NO: 90185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagctagcagatggagaagt

SEQ ID NO: 90186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agatcctggagctagcagat

SEQ ID NO: 90187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacacgttgagatcctggag

SEQ ID NO: 90188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatggagaagaaacaggga

SEQ ID NO: 90189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaatggagaagaaacagg

SEQ ID NO: 90190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctgaaatggagaagaaac

SEQ ID NO: 90191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctgaaatggagaagaaa

SEQ ID NO: 90192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggatgaagtttattctgaaa

SEQ ID NO: 90193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaatgtctaggatgaag

SEQ ID NO: 90194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aagaaaaaaaattaaaaaaa

SEQ ID NO: 90195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtctcaagaaaaaaaatta

SEQ ID NO: 90196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaacagagcgagactcag

SEQ ID NO: 90197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctgggcaacagagcgagac

SEQ ID NO: 90198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctgggcaacagagcga

SEQ ID NO: 90199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cactcctgcctgggcaacag

SEQ ID NO: 90200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatcgagccactgcactcc

SEQ ID NO: 90201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtgagctgagatcgagcc

SEQ ID NO: 90202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggagatggaggttgcagtga

SEQ ID NO: 90203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aacctgggagatggaggttg

SEQ ID NO: 90204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctgaacctgggagatggag

SEQ ID NO: 90205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggagaattgcctgaa

SEQ ID NO: 90206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gggaggctgaggcaggagaa

SEQ ID NO: 90207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcgggaggctgaggcaggag

SEQ ID NO: 90208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcgggaggctgaggcagga

SEQ ID NO: 90209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagtcccagcttctcgggag

SEQ ID NO: 90210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccaggcatggtggccagca

SEQ ID NO: 90211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaaaatacaaaaactatc

SEQ ID NO: 90212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaaaaaaatacaaaaact

SEQ ID NO: 90213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaaaaaaatacaaaaa

SEQ ID NO: 90214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcaacatagtgaaacccca

SEQ ID NO: 90215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagaccagcctggtcaacat

SEQ ID NO: 90216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtcaggagttggagacca

SEQ ID NO: 90217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggtcaggagttggagacc

SEQ ID NO: 90218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcacttgaggtcaggagtt

SEQ ID NO: 90219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggcaggctgatcacttgag

SEQ ID NO: 90220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaggctgaggcaggctgat

SEQ ID NO: 90221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaggctgaggcaggctga

SEQ ID NO: 90222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tggaaggctgaggcaggctg

SEQ ID NO: 90223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgcccgtaatccagcacttt

SEQ ID NO: 90224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acgcccgtaatccagcactt

SEQ ID NO: 90225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggtgggccaggcgcggtgg

SEQ ID NO: 90226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagggaaatatgtataaaa

SEQ ID NO: 90227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaaagaggaatggtgtaa

SEQ ID NO: 90228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaaagaggaatggtgta

SEQ ID NO: 90229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccaaggtagaaaagatttg

SEQ ID NO: 90230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccccaaggtagaaaagattt

SEQ ID NO: 90231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaatgggaaaaaggccttcc

SEQ ID NO: 90232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaactgaaatgggaaaaa

SEQ ID NO: 90233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acattaaaaaactgaaatgg

SEQ ID NO: 90234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacattaaaaaactgaaatg

SEQ ID NO: 90235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacattaaaaaactgaaat

SEQ ID NO: 90236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttaacattaaaaaactga

SEQ ID NO: 90237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttaacattaaaaaactg

SEQ ID NO: 90238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttaacattaaaaaact

SEQ ID NO: 90239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gcatattttgttttaacatt

SEQ ID NO: 90240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgattcgcatattttgtttt

SEQ ID NO: 90241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctatgattcgcatattttgt

SEQ ID NO: 90242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctatgattcgcatattttg

SEQ ID NO: 90243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgctatgattcgcatatttt

SEQ ID NO: 90244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actttgctatgattcgcata

SEQ ID NO: 90245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gactttgctatgattcgcat

SEQ ID NO: 90246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgacttgactttgctatgat

SEQ ID NO: 90247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctgtgacttgactttgctat

SEQ ID NO: 90248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cactactgtgacttgacttt

SEQ ID NO: 90249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcactactgtgacttgac

SEQ ID NO: 90250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggagtattattgcactactg

SEQ ID NO: 90251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtctaggagtattattgcac

SEQ ID NO: 90252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctggtctaggagtattattg

SEQ ID NO: 90253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctggtctaggagtattatt

SEQ ID NO: 90254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctggtctaggagtattat

SEQ ID NO: 90255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttcctggtctaggagta

SEQ ID NO: 90256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactttcctggtctaggagt

SEQ ID NO: 90257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatgacttcactttcctggt

SEQ ID NO: 90258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggttgaatgacttcactt

SEQ ID NO: 90259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataggttgaatgacttcact

SEQ ID NO: 90260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataggttgaatgacttcac

SEQ ID NO: 90261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttataggttgaatgactt

SEQ ID NO: 90262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagttgttttataggttgaa

SEQ ID NO: 90263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagttgttttataggttga

SEQ ID NO: 90264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaagttgttttataggttg

SEQ ID NO: 90265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgaagttgttttataggtt

SEQ ID NO: 90266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgtttttgaagttgttt

SEQ ID NO: 90267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtgtttttgaagttgtt

SEQ ID NO: 90268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcatttaaagtgtttttga

SEQ ID NO: 90269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgaaaagagtacctatgcat

SEQ ID NO: 90270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagacattatgaaaagagta

SEQ ID NO: 90271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagacattatgaaaagagt

SEQ ID NO: 90272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggaagtttgaagacatta

SEQ ID NO: 90273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtggaagtttgaagacatt

SEQ ID NO: 90274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtggaagtttgaagacat

SEQ ID NO: 90275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtcaaaatagagattttgg

SEQ ID NO: 90276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgttaagtcaaaatagagat

SEQ ID NO: 90277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggggtatattgtgttaagt

SEQ ID NO: 90278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgaggggtatattgtgtta

SEQ ID NO: 90279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gacaccaattcctgaggggt

SEQ ID NO: 90280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggacaccaattcctgagggg

SEQ ID NO: 90281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttggacaccaattcctgagg

SEQ ID NO: 90282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttggacaccaattcctgag

SEQ ID NO: 90283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttggacaccaattcctg

SEQ ID NO: 90284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttggacaccaattcct

SEQ ID NO: 90285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcttggacaccaattcc

SEQ ID NO: 90286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattttcttcttggacacca

SEQ ID NO: 90287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattttcttcttggacacc

SEQ ID NO: 90288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttcaattttcttcttggac

SEQ ID NO: 90289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagaaaacaacaaaaaaag

SEQ ID NO: 90290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagctaatagaaaacaacaa

SEQ ID NO: 90291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatcatgtaattacagctaa

SEQ ID NO: 90292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caatcaaacatactaaatca

SEQ ID NO: 90293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaatcaaacatactaaatc

SEQ ID NO: 90294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catttgcaatcaaacatact

SEQ ID NO: 90295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaataaaattacatttgcaa

SEQ ID NO: 90296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggagctaaaataaaatta

SEQ ID NO: 90297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatggagctaaaataaaatt

SEQ ID NO: 90298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acccttaatggagctaaaat

SEQ ID NO: 90299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacccttaatggagctaaaa

SEQ ID NO: 90300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaatatgtttaaccctta

SEQ ID NO: 90301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatcaaatatgtttaaccct

SEQ ID NO: 90302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaagcattctatcaaatat

SEQ ID NO: 90303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgctaccaagcattctatca

SEQ ID NO: 90304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggttacgctaccaagcat

SEQ ID NO: 90305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacataccccacacagatat

SEQ ID NO: 90306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcacataccccacacagata

SEQ ID NO: 90307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caagaatacgtttgcacata

SEQ ID NO: 90308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattccaagaatacgttt

SEQ ID NO: 90309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atatattccaagaatacgtt

SEQ ID NO: 90310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggaaagaaatcttatata

SEQ ID NO: 90311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataggaaagaaatcttatat

SEQ ID NO: 90312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataggaaagaaatcttata

SEQ ID NO: 90313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttataggaaagaaatcttat

SEQ ID NO: 90314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttataggaaagaaatctt

SEQ ID NO: 90315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttataggaaagaaatct

SEQ ID NO: 90316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataacatacacatttcttt

SEQ ID NO: 90317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaataacatacacatttctt

SEQ ID NO: 90318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacttgaataacatacacat

SEQ ID NO: 90319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaaacttgaataacataca

SEQ ID NO: 90320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaatggttactaaacttga

SEQ ID NO: 90321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaagactcacaatggttac

SEQ ID NO: 90322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaagactcacaatggtta

SEQ ID NO: 90323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccaaagactcacaatggtt

SEQ ID NO: 90324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acctttccaaagactcacaa

SEQ ID NO: 90325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cctaacctttccaaagactc

SEQ ID NO: 90326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaaattacctaacctttcc

SEQ ID NO: 90327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggctcagaaattacctaac

SEQ ID NO: 90328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtgagaacactaaggctc

SEQ ID NO: 90329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggtgagaacactaaggct

SEQ ID NO: 90330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgaccaccatttgaggtga

SEQ ID NO: 90331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatcctcatgaccaccattt

SEQ ID NO: 90332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatcctcatgaccaccatt

SEQ ID NO: 90333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgtttaaatcctcatgacca

SEQ ID NO: 90334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatgctccgtttaaatcct

SEQ ID NO: 90335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatgctccgtttaaatcc

SEQ ID NO: 90336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatatgctccgtttaaatc

SEQ ID NO: 90337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agggattttcatatgctccg

SEQ ID NO: 90338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaagggattttcatatgct

SEQ ID NO: 90339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttaagggattttcatatgc

SEQ ID NO: 90340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcagtttgttaagggattt

SEQ ID NO: 90341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
actgagcagtttgttaaggg

SEQ ID NO: 90342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgctaactgagcagtttgt

SEQ ID NO: 90343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatgctaactgagcagtttg

SEQ ID NO: 90344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttaatgctaactgagcagt

SEQ ID NO: 90345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtatggacgtctccttaat

SEQ ID NO: 90346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtatggacgtctccttaa

SEQ ID NO: 90347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgtaacagtcttatgtatg

SEQ ID NO: 90348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatattaatgtaacagtc

SEQ ID NO: 90349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgataatattaatgtaaca

SEQ ID NO: 90350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acattactgataatattaat

SEQ ID NO: 90351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaacattactgataatatt

SEQ ID NO: 90352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctaacattactgataatat

SEQ ID NO: 90353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catcttgctaacattactga

SEQ ID NO: 90354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatcttgctaacattactg

SEQ ID NO: 90355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaggaaaaatacatacgga

SEQ ID NO: 90356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttacaaggaaaaatacatac

SEQ ID NO: 90357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgctgttacaaggaaaaata

SEQ ID NO: 90358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcaaggccagcaattatgc

SEQ ID NO: 90359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggtgtaagccactgtgca

SEQ ID NO: 90360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggattacaggtgtaagccac

SEQ ID NO: 90361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagtgttgggattacaggtg

SEQ ID NO: 90362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaagtgttgggattacagg

SEQ ID NO: 90363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaagtgttgggattacag

SEQ ID NO: 90364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggccttctaaagtgttggga

SEQ ID NO: 90365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccacctcggccttctaaag

SEQ ID NO: 90366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aggtgatctgcccacctcgg

SEQ ID NO: 90367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctcaggtgatctgcccac

SEQ ID NO: 90368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgacctcaggtgatctgcc

SEQ ID NO: 90369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaattcctgacctcaggtga

SEQ ID NO: 90370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtctcgaattcctgacctca

SEQ ID NO: 90371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gccagactagtctcgaattc

SEQ ID NO: 90372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accatgttggccagactagt

SEQ ID NO: 90373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccatgttggccagactag

SEQ ID NO: 90374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagatggggtttcacca

SEQ ID NO: 90375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagatggggtttcacc

SEQ ID NO: 90376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagatggggtttcac

SEQ ID NO: 90377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagttttagtagagatgggg

SEQ ID NO: 90378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagttttagtagagatggg

SEQ ID NO: 90379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcagttttagtagagatgg

SEQ ID NO: 90380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgcagttttagtagag

SEQ ID NO: 90381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcatgtaccaccatgcc

SEQ ID NO: 90382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaggcatgtaccac

SEQ ID NO: 90383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaagtagctgggattacag

SEQ ID NO: 90384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcccaagtagctggga

SEQ ID NO: 90385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcccaagtagct

SEQ ID NO: 90386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctcccaagta

SEQ ID NO: 90387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcctcccaag

SEQ ID NO: 90388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtgattctcctgcctcag

SEQ ID NO: 90389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccagattcaagtgattctcc

SEQ ID NO: 90390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcccagattcaagtgatt

SEQ ID NO: 90391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcctcccagattcaagtga

SEQ ID NO: 90392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacctctgcctcccagatt

SEQ ID NO: 90393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gctgcaacctctgcctccca

SEQ ID NO: 90394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcgctgcaacctctgcct

SEQ ID NO: 90395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtggtacgatgtt

SEQ ID NO: 90396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcagtgg

SEQ ID NO: 90397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgcccaggctggagtgcag

SEQ ID NO: 90398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttgcccaggctggagtgc

SEQ ID NO: 90399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actctgttgcccaggctgga

SEQ ID NO: 90400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactctgttgcccaggctgg

SEQ ID NO: 90401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cataggtaaaggtgtgccgg

SEQ ID NO: 90402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acataggtaaaggtgtgccg

SEQ ID NO: 90403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacataggtaaaggtgtgcc

SEQ ID NO: 90404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacataggtaaaggtgtgc

SEQ ID NO: 90405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttacataggtaaaggtgtg

SEQ ID NO: 90406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caggatgtgcaggtttttta

SEQ ID NO: 90407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaggatgtgcaggtttttt

SEQ ID NO: 90408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggtacatttgcaggatgt

SEQ ID NO: 90409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaggtacatttgcaggatg

SEQ ID NO: 90410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtttcaaggtacatttgca

SEQ ID NO: 90411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attaagtttcaaggtacatt

SEQ ID NO: 90412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattaagtttcaaggtacat

SEQ ID NO: 90413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taattaagtttcaaggtaca

SEQ ID NO: 90414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaattaagtttcaaggtac

SEQ ID NO: 90415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaattaagtttcaaggta

SEQ ID NO: 90416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaattaagtttcaaggt

SEQ ID NO: 90417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaattaagtttcaagg

SEQ ID NO: 90418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaattaagtttcaag

SEQ ID NO: 90419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttaattaagtttcaa

SEQ ID NO: 90420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttaattaagtttca

SEQ ID NO: 90421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttaattaagtttc

SEQ ID NO: 90422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttaattaagttt

SEQ ID NO: 90423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttaattaagtt

SEQ ID NO: 90424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttaattaagt

SEQ ID NO: 90425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttttaattaag

SEQ ID NO: 90426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttttttaattaa

SEQ ID NO: 90427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttttttttttaatta

SEQ ID NO: 90428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttttttttttttttaat

SEQ ID NO: 90429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taggcgtgagccaccatgcc

SEQ ID NO: 90430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattataggcgtgagccac

SEQ ID NO: 90431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggccccccaaagtgctggga

SEQ ID NO: 90432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccgcctaggccccccaaag

SEQ ID NO: 90433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtgatctgcccgcctagg

SEQ ID NO: 90434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agttcaggtgatctgcccgc

SEQ ID NO: 90435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgagttcaggtgatctgcc

SEQ ID NO: 90436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcctgagttcaggtgat

SEQ ID NO: 90437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaactcctgagttcaggtga

SEQ ID NO: 90438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcttgaactcctgagttca

SEQ ID NO: 90439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcaggctggtcttgaactc

SEQ ID NO: 90440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accaggttgggcaggctggt

SEQ ID NO: 90441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccaggttgggcaggctgg

SEQ ID NO: 90442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagataggatttcacca

SEQ ID NO: 90443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagataggatttcacc

SEQ ID NO: 90444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagataggatttcac

SEQ ID NO: 90445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagataggatttca

SEQ ID NO: 90446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagatagga

SEQ ID NO: 90447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagatagg

SEQ ID NO: 90448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagatag

SEQ ID NO: 90449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attttgtatttttagtagag

SEQ ID NO: 90450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctaattttgtatttttagt

SEQ ID NO: 90451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gcctggctaattttgtattt

SEQ ID NO: 90452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caggcatgagccacctcgcc

SEQ ID NO: 90453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccgagtagccgggattacag

SEQ ID NO: 90454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctcccgagtagccggga

SEQ ID NO: 90455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctcccgagtagcc

SEQ ID NO: 90456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctcccgagta

SEQ ID NO: 90457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcctcccgag

SEQ ID NO: 90458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcaattctcctgcctcag

SEQ ID NO: 90459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggttcaagcaattctcc

SEQ ID NO: 90460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgcctcccaggttcaagcaa

SEQ ID NO: 90461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccgcctcccaggttcaagca

SEQ ID NO: 90462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caacttccgcctcccaggtt

SEQ ID NO: 90463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaacttccgcctccca

SEQ ID NO: 90464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcactgcaacttccgcct

SEQ ID NO: 90465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcactgcaacttccgcc

SEQ ID NO: 90466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcaatggtacgatctt

SEQ ID NO: 90467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaggctggagtgcaatgg

SEQ ID NO: 90468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgcccaggctggagtgcaa

SEQ ID NO: 90469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttgcccaggctggagtgca

SEQ ID NO: 90470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttgcccaggctggagtg

SEQ ID NO: 90471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcttgttgcccaggctgg

SEQ ID NO: 90472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactcttgttgcccaggctg

SEQ ID NO: 90473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaccgagtttcactcttgt

SEQ ID NO: 90474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaccgagtttcactcttg

SEQ ID NO: 90475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaccgagtttcactctt

SEQ ID NO: 90476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagaccgagtttcactct

SEQ ID NO: 90477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagaccgagtttcactc

SEQ ID NO: 90478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagaccgagtttcact

SEQ ID NO: 90479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttgagaccgagtttcac

SEQ ID NO: 90480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttgagaccgagtttca

SEQ ID NO: 90481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttgagaccgagtttc

SEQ ID NO: 90482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttgagaccgagttt

SEQ ID NO: 90483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttgagaccgagtt

SEQ ID NO: 90484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttttgagaccgagt

SEQ ID NO: 90485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttttgagaccgag

SEQ ID NO: 90486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttttgagaccga

SEQ ID NO: 90487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttttttttttgagacc

SEQ ID NO: 90488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatcaaaatgcattctttt

SEQ ID NO: 90489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatattataatcaaaatgc

SEQ ID NO: 90490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaatattataatcaaaatg

SEQ ID NO: 90491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataacttagaatattataat

SEQ ID NO: 90492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataacttagaatattataa

SEQ ID NO: 90493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcatttaataacttagaat

SEQ ID NO: 90494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aataatggtatctaggcatt

SEQ ID NO: 90495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacatgataagtagatatga

SEQ ID NO: 90496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acacatgataagtagatatg

SEQ ID NO: 90497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtcttacacatgataagt

SEQ ID NO: 90498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtcttacacatgataag

SEQ ID NO: 90499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagtgtcttacacatgataa

SEQ ID NO: 90500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaaacagccactttagtgt

SEQ ID NO: 90501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaaaacagccactttagtg

SEQ ID NO: 90502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaaaacagccactttagt

SEQ ID NO: 90503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccaaaacagccactttag

SEQ ID NO: 90504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccaaaacagccacttta

SEQ ID NO: 90505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttttccaaaacagccact

SEQ ID NO: 90506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttttccaaaacagccac

SEQ ID NO: 90507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggagatatatatgtatatac

SEQ ID NO: 90508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattaggagatatatatg

SEQ ID NO: 90509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatagagtatattatata

SEQ ID NO: 90510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgttatatatagagtata

SEQ ID NO: 90511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattatatgttatatataga

SEQ ID NO: 90512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggactatattatatgttat

SEQ ID NO: 90513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaggactatattatatgtt

SEQ ID NO: 90514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaaggactatattatatgt

SEQ ID NO: 90515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttctaaggactatattata

SEQ ID NO: 90516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttctaaggactatattat

SEQ ID NO: 90517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagtatttacttctaagga

SEQ ID NO: 90518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaattagtagtatttactt

SEQ ID NO: 90519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtaaattagtagtattta

SEQ ID NO: 90520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgtaaattagtagtattt

SEQ ID NO: 90521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctgtaaattagtagtatt

SEQ ID NO: 90522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttcctgtaaattagtagt

SEQ ID NO: 90523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatattgctttcctgtaaat

SEQ ID NO: 90524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaatattgctttcctgtaaa

SEQ ID NO: 90525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaatattgctttcctgta

SEQ ID NO: 90526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttaaatattgctttcctgt

SEQ ID NO: 90527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttcttaaatattgctttc

SEQ ID NO: 90528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtcaaatattaatttcttaa

SEQ ID NO: 90529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agtcaaatattaatttctta

SEQ ID NO: 90530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtatgtggtcttagtcaaa

SEQ ID NO: 90531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctcagtatgtggtcttagtc

SEQ ID NO: 90532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actcagtatgtggtcttagt

SEQ ID NO: 90533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tactcagtatgtggtcttag

SEQ ID NO: 90534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttactcagtatgtggtct

SEQ ID NO: 90535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctttactcagtatgtggtc

SEQ ID NO: 90536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaaatatttcctttactca

SEQ ID NO: 90537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccaaatatttcctttactc

SEQ ID NO: 90538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcccaaatatttcctttact

SEQ ID NO: 90539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcccaaatatttcctttac

SEQ ID NO: 90540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcccaaatatttcctt

SEQ ID NO: 90541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttcccaaatatttcct

SEQ ID NO: 90542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatagtgaaaggaagttta

SEQ ID NO: 90543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaattagtatagtgaaagga

SEQ ID NO: 90544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agttcaaattagtatagtga

SEQ ID NO: 90545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagttcaaattagtatagtg

SEQ ID NO: 90546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagcacagataaataaatt

SEQ ID NO: 90547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagtgttaaaagcacaga

SEQ ID NO: 90548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataaagtgttaaaagcacag

SEQ ID NO: 90549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataaagtgttaaaagcaca

SEQ ID NO: 90550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttataaagtgttaaaagcac

SEQ ID NO: 90551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaaatatttttataaagtg

SEQ ID NO: 90552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agactgtaaaatatttttat

SEQ ID NO: 90553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagactgtaaaatattttta

SEQ ID NO: 90554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatttcagactgtaaaatat

SEQ ID NO: 90555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctatatttcagactgtaaaa

SEQ ID NO: 90556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactatatttcagactgtaa

SEQ ID NO: 90557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catctctactatatttcaga

SEQ ID NO: 90558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattacatctctactatatt

SEQ ID NO: 90559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atattacatctctactatat

SEQ ID NO: 90560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaaatttatattacatctct

SEQ ID NO: 90561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaaatttatattacatctc

SEQ ID NO: 90562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaaatttatattacatct

SEQ ID NO: 90563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggcagagaagtgcctttcaa

SEQ ID NO: 90564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaacagctaggcagagaa

SEQ ID NO: 90565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtagaacagctaggcagaga

SEQ ID NO: 90566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaatgaacacttgtagaac

SEQ ID NO: 90567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggaatgaacacttgtagaa

SEQ ID NO: 90568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggaatgaacacttgtaga

SEQ ID NO: 90569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaggaatgaacacttgtag

SEQ ID NO: 90570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acagacttttaggaatgaac

SEQ ID NO: 90571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatcccatgagatcagctg

SEQ ID NO: 90572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataatcccatgagatcagct

SEQ ID NO: 90573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttataatcccatgagatcag

SEQ ID NO: 90574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaataaggttcttataatc

SEQ ID NO: 90575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggatcaactgggaataag

SEQ ID NO: 90576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctcagggatcaactgggaat

SEQ ID NO: 90577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtaggaaaaagggaagtg

SEQ ID NO: 90578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atggtaattcaggtaggaaa

SEQ ID NO: 90579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcatggtaattcaggtag

SEQ ID NO: 90580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcatggtaattcaggta

SEQ ID NO: 90581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaacttggctcatggtaat

SEQ ID NO: 90582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaacttggctcatggtaa

SEQ ID NO: 90583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccccatttacaaacttggct

SEQ ID NO: 90584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaccccatttacaaacttg

SEQ ID NO: 90585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaccccatttacaaactt

SEQ ID NO: 90586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgttaccccatttacaaac

SEQ ID NO: 90587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaaatatgtattcttgtt

SEQ ID NO: 90588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacaaaatatgtattcttgt

SEQ ID NO: 90589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttaacaaaatatgtattctt

SEQ ID NO: 90590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctcttaacaaaatatgtat

SEQ ID NO: 90591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctcttaacaaaatatgta

SEQ ID NO: 90592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttccctcttaacaaaatat

SEQ ID NO: 90593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtttccctcttaacaaaata

SEQ ID NO: 90594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagtgatgaatttgtttccc

SEQ ID NO: 90595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaagttgaagtgatgaatt

SEQ ID NO: 90596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catggaacaaaatattataa

SEQ ID NO: 90597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcatggaacaaaatattata

SEQ ID NO: 90598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcatggaacaaaatattat

SEQ ID NO: 90599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaatgatctttgcatggaa

SEQ ID NO: 90600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaaatgatctttgcatgga

SEQ ID NO: 90601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaaatgatctttgcatgg

SEQ ID NO: 90602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgggaccaatctttgtaaat

SEQ ID NO: 90603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtaaatattatgggaccaa

SEQ ID NO: 90604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taggtaaatattatgggacc

SEQ ID NO: 90605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctaggtaaatattatgggac

SEQ ID NO: 90606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttctaggtaaatattatgg

SEQ ID NO: 90607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtgattccttctaggtaaa

SEQ ID NO: 90608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgagtgattccttctagg

SEQ ID NO: 90609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atctgagtgattccttctag

SEQ ID NO: 90610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatctgagtgattccttcta

SEQ ID NO: 90611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaagtgatgcctttatctg

SEQ ID NO: 90612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggtaagtgatgcctttat

SEQ ID NO: 90613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attggtaagtgatgccttta

SEQ ID NO: 90614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattggtaagtgatgccttt

SEQ ID NO: 90615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatgctttattggtaagtga

SEQ ID NO: 90616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aataggatgaattaaatgct

SEQ ID NO: 90617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaataggatgaattaaatgc

SEQ ID NO: 90618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaataggatgaattaaatg

SEQ ID NO: 90619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggacattttgaataggatg

SEQ ID NO: 90620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgaggacattttgaatagg

SEQ ID NO: 90621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgaggacattttgaatag

SEQ ID NO: 90622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agagtaaagataatttattg

SEQ ID NO: 90623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggctcagagtaaagataat

SEQ ID NO: 90624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agggctcagagtaaagataa

SEQ ID NO: 90625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagggctcagagtaaagata

SEQ ID NO: 90626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttagggctcagagtaaagat

SEQ ID NO: 90627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atagacagtgtatcttttag

SEQ ID NO: 90628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagtctaatagacagtgtat

SEQ ID NO: 90629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caagtctaatagacagtgta

SEQ ID NO: 90630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaagtctaatagacagtgt

SEQ ID NO: 90631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcaagtctaatagacagt

SEQ ID NO: 90632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctttcaagtctaatagac

SEQ ID NO: 90633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgactattctttcaagtc

SEQ ID NO: 90634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctaaatgactattctttcaa

SEQ ID NO: 90635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tactaaatgactattctttc

SEQ ID NO: 90636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agctctactaaatgactatt

SEQ ID NO: 90637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagctctactaaatgactat

SEQ ID NO: 90638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttaagctctactaaatga

SEQ ID NO: 90639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatattgatttaagctcta

SEQ ID NO: 90640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatattgatttaagctct

SEQ ID NO: 90641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatttcatatattgatttaa

SEQ ID NO: 90642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatttcatatattgattta

SEQ ID NO: 90643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatttatatttcatatatt

SEQ ID NO: 90644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caaaaaaattaaaatttata

SEQ ID NO: 90645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaaaaaaattaaaattta

SEQ ID NO: 90646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacaaaaaaattaaaattt

SEQ ID NO: 90647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttctacaaaaaaattaaaa

SEQ ID NO: 90648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcaataaaaggaaaatctg

SEQ ID NO: 90649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatcagcctgggcaataaaa

SEQ ID NO: 90650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatcagcctgggcaataa

SEQ ID NO: 90651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atccaggagttctagatcag

SEQ ID NO: 90652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatccaggagttctagatca

SEQ ID NO: 90653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgatccaggagttctaga

SEQ ID NO: 90654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaggattgcttgatccagga

SEQ ID NO: 90655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaggccgaggctggaggat

SEQ ID NO: 90656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gggaggccgaggctggagga

SEQ ID NO: 90657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgggaggccgaggctggagg

SEQ ID NO: 90658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatcccatcactttgggag

SEQ ID NO: 90659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtcacccctgcaatcccatc

SEQ ID NO: 90660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcaggcacagctggtcac

SEQ ID NO: 90661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgataataaaatattatgt

SEQ ID NO: 90662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgataataaaatattatg

SEQ ID NO: 90663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatccatgcagatgagtaa

SEQ ID NO: 90664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaaaagaagtaaatgtaga

SEQ ID NO: 90665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaaaagaagtaaatgtag

SEQ ID NO: 90666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaatttgaaaaaagaagtaa

SEQ ID NO: 90667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaatttgaaaaaagaagta

SEQ ID NO: 90668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaatttgaaaaaagaagt

SEQ ID NO: 90669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tactttagaatttgaaaaaa

SEQ ID NO: 90670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agagtctatactttagaatt

SEQ ID NO: 90671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagagtctatactttagaat

SEQ ID NO: 90672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgagagtctatactttaga

SEQ ID NO: 90673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttgagagtctatactttag

SEQ ID NO: 90674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatatgtcatcttcttga

SEQ ID NO: 90675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatatgtcatcttcttg

SEQ ID NO: 90676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatatgtcatcttctt

SEQ ID NO: 90677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaaaaatatgtcatctt

SEQ ID NO: 90678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatccaatgtaattatttta

SEQ ID NO: 90679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatccaatgtaattatttt

SEQ ID NO: 90680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaatccaatgtaattattt

SEQ ID NO: 90681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaatccaatgtaattatt

SEQ ID NO: 90682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgtttttaaatccaatgt

SEQ ID NO: 90683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cactatatgtttttaaatcc

SEQ ID NO: 90684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctacactatatgtttttaaa

SEQ ID NO: 90685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctcctacactatatgttttt

SEQ ID NO: 90686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttgctcctacactatatgt

SEQ ID NO: 90687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctagttgctcctacactata

SEQ ID NO: 90688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actagttgctcctacactat

SEQ ID NO: 90689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactagttgctcctacacta

SEQ ID NO: 90690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttactagttgctcctacact

SEQ ID NO: 90691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaacttttactagttgctc

SEQ ID NO: 90692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatgtggtatctgtcaactt

SEQ ID NO: 90693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actggatgtggtatctgtca

SEQ ID NO: 90694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactggatgtggtatctgtc

SEQ ID NO: 90695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggggtaatttcactggatgt

SEQ ID NO: 90696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgggggtaatttcactgg

SEQ ID NO: 90697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactgggggtaatttcactg

SEQ ID NO: 90698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactgggggtaatttcact

SEQ ID NO: 90699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttaactgggggtaatttc

SEQ ID NO: 90700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattttaactgggggtaat

SEQ ID NO: 90701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattttaactgggggt

SEQ ID NO: 90702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattttaactggg

SEQ ID NO: 90703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattttaact

SEQ ID NO: 90704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattatttta

SEQ ID NO: 90705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattattattattattatt

SEQ ID NO: 90713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgatgatgatgatgattat

SEQ ID NO: 90714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaatgatgatgatgatga

SEQ ID NO: 90715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcccattatctaatgatga

SEQ ID NO: 90716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagcatgagccaccgcgct

SEQ ID NO: 90717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggattacaagcatgagccac

SEQ ID NO: 90718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaagtgctgggattacaa

SEQ ID NO: 90719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gacctcccaaagtgctggga

SEQ ID NO: 90720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgatccgcccgcctcgacc

SEQ ID NO: 90721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acctagtgatccgcccgcct

SEQ ID NO: 90722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgacctagtgatccgcccg

SEQ ID NO: 90723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aatctcctgacctagtgatc

SEQ ID NO: 90724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccaggatggtctcaatctc

SEQ ID NO: 90725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accatgttagccaggatggt

SEQ ID NO: 90726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caccatgttagccaggatgg

SEQ ID NO: 90727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtagagacggagtttcacca

SEQ ID NO: 90728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtagagacggagtttcacc

SEQ ID NO: 90729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagtagagacggagtttcac

SEQ ID NO: 90730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagtagagacggagtttca

SEQ ID NO: 90731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatttttagtagagacggag

SEQ ID NO: 90732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatttttagtagagacgga

SEQ ID NO: 90733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtatttttagtagagacgg

SEQ ID NO: 90734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtatttttagtagagacg

SEQ ID NO: 90735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgtttttgtatttttagta

SEQ ID NO: 90736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaccgtgcccggctaatgt

SEQ ID NO: 90737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caggcgcctaccaccgtgcc

SEQ ID NO: 90738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggactacaggcgcctaccac

SEQ ID NO: 90739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgagtagctgggactacagg

SEQ ID NO: 90740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctccgagtagctgggac

SEQ ID NO: 90741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cctcagcctccgagtagctg

SEQ ID NO: 90742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcctcagcctccgagtag

SEQ ID NO: 90743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcctgcctcagcctccgagt

SEQ ID NO: 90744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaccattctcctgcctcag

SEQ ID NO: 90745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggttcacaccattctcctgc

SEQ ID NO: 90746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgcgtcctgggttcacacca

SEQ ID NO: 90747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagctccgcgtcctgggtt

SEQ ID NO: 90748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actgcaagctccgcgtcctg

SEQ ID NO: 90749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcactgcaagctccgcgt

SEQ ID NO: 90750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggctcactgcaagctccgcg

SEQ ID NO: 90751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagtgcagtggcgcgatctt

SEQ ID NO: 90752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcgcccaggctggagtgcag

SEQ ID NO: 90753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtcgcccaggctggagtgc

SEQ ID NO: 90754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gctctgtcgcccaggctgga

SEQ ID NO: 90755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agacggagtctcgctctgtc

SEQ ID NO: 90756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagacggagtctcgctctgt

SEQ ID NO: 90757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagacggagtctcgctctg

SEQ ID NO: 90758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgagacggagtctcgctct

SEQ ID NO: 90759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgagacggagtctcgctc

SEQ ID NO: 90760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgagacggagtctcgct

SEQ ID NO: 90761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttttgagacggagtctc

SEQ ID NO: 90762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttttgagacggagtct

SEQ ID NO: 90763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttttgagacggagtc

SEQ ID NO: 90764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttttttgagacggagt

SEQ ID NO: 90765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttttttgagacggag

SEQ ID NO: 90766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttatttttttgagacg

SEQ ID NO: 90767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttatttttttgagac

SEQ ID NO: 90768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattttttatttttttgaga

SEQ ID NO: 90769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttattttttatttttttgag

SEQ ID NO: 90770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttattttttatttttttga

SEQ ID NO: 90771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttattttttatttttttg

SEQ ID NO: 90772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttattttttattttttt

SEQ ID NO: 90773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttattttttatttttt

SEQ ID NO: 90774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttattttttattttt

SEQ ID NO: 90775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttattttttatttt

SEQ ID NO: 90776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttattttttattt

SEQ ID NO: 90777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttttttttttattttttatt

SEQ ID NO: 90778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttttttttttatttttta

SEQ ID NO: 90779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagattctttttttttttta

SEQ ID NO: 90780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagattctttttttttttt

SEQ ID NO: 90781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagattcttttttttttt

SEQ ID NO: 90782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagattctttttttttt

SEQ ID NO: 90783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atttttaaagattctttttt

SEQ ID NO: 90784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgatttttaaagattctt

SEQ ID NO: 90785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattatctgatttttaaaga

SEQ ID NO: 90786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctgtattatctgattttta

SEQ ID NO: 90787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactccctgtattatctgat

SEQ ID NO: 90788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatgcacacctagactccct

SEQ ID NO: 90789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgctatatgcacacctag

SEQ ID NO: 90790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtgctatatgcacaccta

SEQ ID NO: 90791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtgctatatgcacacct

SEQ ID NO: 90792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataaaaattttatgtgctat

SEQ ID NO: 90793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataaaaattttatgtgcta

SEQ ID NO: 90794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taataaaaattttatgtgct

SEQ ID NO: 90795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaataaaaattttatgtgc

SEQ ID NO: 90796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccataagatttttaataaaa

SEQ ID NO: 90797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacattcccataagattt

SEQ ID NO: 90798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatataagtattaaaaaca

SEQ ID NO: 90799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaagcatgcattaaaatata

SEQ ID NO: 90800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aagaaagataaataagatta

SEQ ID NO: 90801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaagaaagataaataagat

SEQ ID NO: 90802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcctctaaagaaagataaa

SEQ ID NO: 90803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaaattgagcctctaaaga

SEQ ID NO: 90804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtacaaataattggaaaatt

SEQ ID NO: 90805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagtacaaataattggaaa

SEQ ID NO: 90806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtcaaactattagtacaaa

SEQ ID NO: 90807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtcaaactattagtacaa

SEQ ID NO: 90808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggtcaaactattagtaca

SEQ ID NO: 90809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaggtcaaactattagtac

SEQ ID NO: 90810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacttttaggtcaaactatt

SEQ ID NO: 90811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccacttttaggtcaaact

SEQ ID NO: 90812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actccacttttaggtcaaac

SEQ ID NO: 90813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactccacttttaggtcaaa

SEQ ID NO: 90814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atatgtacgccagtaaggca

SEQ ID NO: 90815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatatgtacgccagtaaggc

SEQ ID NO: 90816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caaatgtttgatatgtacgc

SEQ ID NO: 90817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccaaatgtttgatatgtacg

SEQ ID NO: 90818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcttccaaatgtttgatat

SEQ ID NO: 90819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catctcatcttccaaatgtt

SEQ ID NO: 90820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctacatctcatcttccaaat

SEQ ID NO: 90821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctacatctcatcttccaa

SEQ ID NO: 90822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcctacatctcatcttcc

SEQ ID NO: 90823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctcctacatctcatcttc

SEQ ID NO: 90824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctctcctacatctcatct

SEQ ID NO: 90825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttctctcctacatctcatc

SEQ ID NO: 90826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcttctctcctacatctc

SEQ ID NO: 90827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttcttctctcctacatct

SEQ ID NO: 90828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccttcttctctcctacatc

SEQ ID NO: 90829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccttcttctctcctacat

SEQ ID NO: 90830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccttcttctctcctaca

SEQ ID NO: 90831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttccttcttctctcctac

SEQ ID NO: 90832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttccttcttctctccta

SEQ ID NO: 90833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttccttcttctctcct

SEQ ID NO: 90834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttccttcttctctcc

SEQ ID NO: 90835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttccttcttctctc

SEQ ID NO: 90836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttttttttccttcttctct

SEQ ID NO: 90837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttttttttccttcttct

SEQ ID NO: 90838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttttttttccttcttc

SEQ ID NO: 90839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttttttttttccttctt

SEQ ID NO: 90840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctttttttttttccttct

SEQ ID NO: 90841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctttttttttttccttc

SEQ ID NO: 90842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caatgaatgccctttttctt

SEQ ID NO: 90843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctgcaatgaatgcccttt

SEQ ID NO: 90844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcatcctgccctgcaatgaa

SEQ ID NO: 90845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttagcatcctgccctgca

SEQ ID NO: 90846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattaagttagcatcctgc

SEQ ID NO: 90847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaattaagttagcatcctg

SEQ ID NO: 90848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaagagtgtgtacatttac

SEQ ID NO: 90849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaagagtgtgtacattta

SEQ ID NO: 90850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaatttagaaagagtgtgt

SEQ ID NO: 90851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaaatttagaaagagtgtg

SEQ ID NO: 90852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acttggaaatttagaaagag

SEQ ID NO: 90853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcacttggaaatttagaaa

SEQ ID NO: 90854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggattgttcacttggaaatt

SEQ ID NO: 90855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacctaggattgttcacttg

SEQ ID NO: 90856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgcacctaggattgttca

SEQ ID NO: 90857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taattgcacctaggattgtt

SEQ ID NO: 90858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaaaatacaataaagctct

SEQ ID NO: 90859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcaaaatacaataaagctc

SEQ ID NO: 90860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aatcatttatcaaaatacaa

SEQ ID NO: 90861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaatcatttatcaaaatac

SEQ ID NO: 90862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgaatcatttatcaaaata

SEQ ID NO: 90863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctgaatcatttatcaaaat

SEQ ID NO: 90864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caaagctttctgaatcattt

SEQ ID NO: 90865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaaagctttctgaatcatt

SEQ ID NO: 90866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaaagctttctgaatcat

SEQ ID NO: 90867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaaagctttctgaatca

SEQ ID NO: 90868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttacaaagctttctgaatc

SEQ ID NO: 90869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattttttacaaagctttct

SEQ ID NO: 90870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggattttttacaaagctttc

SEQ ID NO: 90871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttggattttttacaaagct

SEQ ID NO: 90872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatgtctccttggattttt

SEQ ID NO: 90873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatgtctccttggatttt

SEQ ID NO: 90874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaatgtctccttggattt

SEQ ID NO: 90875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaaatgtctccttggat

SEQ ID NO: 90876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaaaatgtctccttgga

SEQ ID NO: 90877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atcataaatttctttaaaat

SEQ ID NO: 90878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgatcataaatttctttaa

SEQ ID NO: 90879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttactgatcataaatttctt

SEQ ID NO: 90880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctattactgatcataaattt

SEQ ID NO: 90881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagagactgctattactgat

SEQ ID NO: 90882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtcaagtgttagagagact

SEQ ID NO: 90883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatgtcaagtgttagagag

SEQ ID NO: 90884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttatgtcaagtgttagaga

SEQ ID NO: 90885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttgttatgtcaagtgttaga

SEQ ID NO: 90886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcttgttatgtcaagtgtt

SEQ ID NO: 90887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcttgttatgtcaagtgt

SEQ ID NO: 90888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgatttcctcttgttatgtc

SEQ ID NO: 90889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgatttcctcttgttatgt

SEQ ID NO: 90890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgatttcctcttgttatg

SEQ ID NO: 90891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttatgatttcctcttgt

SEQ ID NO: 90892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcattttatgatttcctct

SEQ ID NO: 90893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattcattttatgatttcc

SEQ ID NO: 90894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctattcattttatgatttc

SEQ ID NO: 90895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgctattcattttatgat

SEQ ID NO: 90896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgctattcattttatga

SEQ ID NO: 90897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatttccttgctattcatt

SEQ ID NO: 90898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actgtaatttccttgctatt

SEQ ID NO: 90899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactgtaatttccttgctat

SEQ ID NO: 90900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taactgtaatttccttgcta

SEQ ID NO: 90901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttaactgtaatttccttg

SEQ ID NO: 90902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acgttactttaactgtaatt

SEQ ID NO: 90903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaacctaacgttactttaac

SEQ ID NO: 90904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgaaacctaacgttacttt

SEQ ID NO: 90905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgttgaaacctaacgttac

SEQ ID NO: 90906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtgatataacatggagcc

SEQ ID NO: 90907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaagtgatataacatggagc

SEQ ID NO: 90908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaagtgatataacatggag

SEQ ID NO: 90909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaagtgatataacatgga

SEQ ID NO: 90910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaagtgatataacatgg

SEQ ID NO: 90911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattttttaaagtgatataa

SEQ ID NO: 90912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agattttttaaagtgatata

SEQ ID NO: 90913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagattttttaaagtgatat

SEQ ID NO: 90914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctttagattttttaaagtg

SEQ ID NO: 90915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acacaggagatgaactatct

SEQ ID NO: 90916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacacaggagatgaactatc

SEQ ID NO: 90917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacacaggagatgaactat

SEQ ID NO: 90918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaacacaggagatgaact

SEQ ID NO: 90919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaacacaggagatgaac

SEQ ID NO: 90920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctttaacacaggagatg

SEQ ID NO: 90921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgtttctttaacacaggag

SEQ ID NO: 90922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgttgtttctttaacacag

SEQ ID NO: 90923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagcaaaaaatatgttgtt

SEQ ID NO: 90924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaagcaaaaaatatgtt

SEQ ID NO: 90925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actgtaagcaaaaaatatgt

SEQ ID NO: 90926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataacaacttactgtaag

SEQ ID NO: 90927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataacaacttactgtaa

SEQ ID NO: 90928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataacaacttactgta

SEQ ID NO: 90929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaataacaacttactgt

SEQ ID NO: 90930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttaaaataacaacttactg

SEQ ID NO: 90931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttttaaaataacaacttac

SEQ ID NO: 90932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacgtctctttttaaaataa

SEQ ID NO: 90933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacgtctctttttaaaata

SEQ ID NO: 90934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccacgtctctttttaaaat

SEQ ID NO: 90935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttccacgtctctttttaaa

SEQ ID NO: 90936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tagagaaaaccgttctttcc

SEQ ID NO: 90937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatagagaaaaccgttcttt

SEQ ID NO: 90938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttctatagagaaaaccgtt

SEQ ID NO: 90939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttctatagagaaaaccgt

SEQ ID NO: 90940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttctatagagaaaaccg

SEQ ID NO: 90941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagttctatagagaaaacc

SEQ ID NO: 90942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagttctatagagaaaac

SEQ ID NO: 90943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatctttttagttctataga

SEQ ID NO: 90944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatatctttttagttctata

SEQ ID NO: 90945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctatatctttttagttct

SEQ ID NO: 90946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aattattctatatcttttta

SEQ ID NO: 90947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acatatgtagaactgaatta

SEQ ID NO: 90948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aattgacatatgtagaactg

SEQ ID NO: 90949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaattgacatatgtagaact

SEQ ID NO: 90950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacagacaagtttgaattg

SEQ ID NO: 90951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aacagtgccagtaagcataa

SEQ ID NO: 90952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaacagtgccagtaagcata

SEQ ID NO: 90953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtggtgaggaaaaatgcca

SEQ ID NO: 90954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggtggtgaggaaaaatgc

SEQ ID NO: 90955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgggtggtgaggaaaaatg

SEQ ID NO: 90956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaggaatgaaacccttctgg

SEQ ID NO: 90957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaggaatgaaacccttctg

SEQ ID NO: 90958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaggtggaatgaagtttgga

SEQ ID NO: 90959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcagctaaaggtggaatgaa

SEQ ID NO: 90960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggcagctaaaggtggaatga

SEQ ID NO: 90961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttggcagctaaaggtggaat

SEQ ID NO: 90962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcaaaagaaaaagccatca

SEQ ID NO: 90963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcaaaagaaaaagccatc

SEQ ID NO: 90964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taggcaaaagaaaaagccat

SEQ ID NO: 90965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaggaaatggctttaggca

SEQ ID NO: 90966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggaaggaaatggctttag

SEQ ID NO: 90967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gctggaaggaaatggcttta

SEQ ID NO: 90968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccttgctggaaggaaatggc

SEQ ID NO: 90969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgccttgctggaaggaaatg

SEQ ID NO: 90970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctctgccttgctggaaggaa

SEQ ID NO: 90971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctctgccttgctggaagga

SEQ ID NO: 90972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctctgccttgctggaagg

SEQ ID NO: 90973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccctttcctctgccttgctg

SEQ ID NO: 90974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
accctttcctctgccttgct

SEQ ID NO: 90975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggtatcacttaccctttc

SEQ ID NO: 90976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgaaggtatcacttaccc

SEQ ID NO: 90977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgaaggtatcacttacc

SEQ ID NO: 90978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcattgaaggtatcactta

SEQ ID NO: 90979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcattgaaggtatcactt

SEQ ID NO: 90980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaaatgaaatttcttcatt

SEQ ID NO: 90981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taaaaaatgaaatttcttca

SEQ ID NO: 90982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccattctaaaaaatgaaatt

SEQ ID NO: 90983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtgtcctgccattctaaaaa

SEQ ID NO: 90984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtgtcctgccattctaaaa

SEQ ID NO: 90985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtgtcctgccattctaaa

SEQ ID NO: 90986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggaatatgagataacaatt

SEQ ID NO: 90987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtggaatatgagataacaat

SEQ ID NO: 90988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtggaatatgagataacaa

SEQ ID NO: 90989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgtggaatatgagataaca

SEQ ID NO: 90990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgagagcatccagagaatgt

SEQ ID NO: 90991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgagagcatccagagaatg

SEQ ID NO: 90992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatgaggatttatgagagca

SEQ ID NO: 90993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatgaggatttatgagagc

SEQ ID NO: 90994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatgaggatttatgagag

SEQ ID NO: 90995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tataaaaatattttatatga

SEQ ID NO: 90996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taaaattgtataaaaatatt

SEQ ID NO: 90997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatagatattataaaattg

SEQ ID NO: 90998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaggcaaggtcatattaaa

SEQ ID NO: 90999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagaggcaaggtcatattaa

SEQ ID NO: 91000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacttgagaggcaaggtca

SEQ ID NO: 91001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gattaccacttgagaggcaa

SEQ ID NO: 91002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtagagttagattaccact

SEQ ID NO: 91003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaactgtgtagagttagatt

SEQ ID NO: 91004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaactgtgtagagttagat

SEQ ID NO: 91005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tagaactgtgtagagttaga

SEQ ID NO: 91006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctttagaactgtgtagagtt

SEQ ID NO: 91007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctttagaactgtgtagagt

SEQ ID NO: 91008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgacatcttcctttagaact

SEQ ID NO: 91009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagaagtattatgacatctt

SEQ ID NO: 91010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagaagtattatgacatct

SEQ ID NO: 91011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacagaagtattatgacatc

SEQ ID NO: 91012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttacagaagtattatgaca

SEQ ID NO: 91013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctttacagaagtattatg

SEQ ID NO: 91014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attctttacagaagtattat

SEQ ID NO: 91015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atttattctttacagaagta

SEQ ID NO: 91016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctaatttattctttacaga

SEQ ID NO: 91017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cacatcacaaattagctaat

SEQ ID NO: 91018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atattacacatcacaaatta

SEQ ID NO: 91019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catattacacatcacaaatt

SEQ ID NO: 91020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagatggtccttcatattac

SEQ ID NO: 91021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgaagatggtccttcata

SEQ ID NO: 91022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtactaattgaagatggtc

SEQ ID NO: 91023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagggcatctgtgtactaat

SEQ ID NO: 91024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattggagggcatctgtgta

SEQ ID NO: 91025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggatgttgtattggagggc

SEQ ID NO: 91026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagaggacatattgtggatg

SEQ ID NO: 91027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaagaggacatattgtgga

SEQ ID NO: 91028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctgaagaggacatattgt

SEQ ID NO: 91029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctctgaagaggacatattg

SEQ ID NO: 91030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaatttgctctgaagagga

SEQ ID NO: 91031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaatttgctctgaagagg

SEQ ID NO: 91032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaatttgctctgaagag

SEQ ID NO: 91033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaatttgctctgaaga

SEQ ID NO: 91034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagcagggatttttaaaaa

SEQ ID NO: 91035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
attgtgagcagggattttta

SEQ ID NO: 91036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actaattgtgagcagggatt

SEQ ID NO: 91037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactaattgtgagcagggat

SEQ ID NO: 91038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcactaattgtgagcagg

SEQ ID NO: 91039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattatttcactaattgtga

SEQ ID NO: 91040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaggactaaattatttcact

SEQ ID NO: 91041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaggactaaattatttcac

SEQ ID NO: 91042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catcttgaaggactaaatta

SEQ ID NO: 91043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacattacatcttgaagga

SEQ ID NO: 91044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttaccacattacatcttga

SEQ ID NO: 91045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttaccacattacatcttg

SEQ ID NO: 91046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtaaataatttggttaccac

SEQ ID NO: 91047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggtaaataatttggttacca

SEQ ID NO: 91048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggtaaataatttggttacc

SEQ ID NO: 91049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggtaaataatttggttac

SEQ ID NO: 91050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtagcaaatggccagccac

SEQ ID NO: 91051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtagcaaatggccagcca

SEQ ID NO: 91052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtagcaaatggccagcc

SEQ ID NO: 91053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatgtagcaaatggccagc

SEQ ID NO: 91054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatgtagcaaatggccag

SEQ ID NO: 91055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttatgtagcaaatggcca

SEQ ID NO: 91056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgatttttttatgtagcaa

SEQ ID NO: 91057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attaatgatttttttatgta

SEQ ID NO: 91058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtgacaaactgattaatga

SEQ ID NO: 91059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattaggtgacaaactgatt

SEQ ID NO: 91060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caattaggtgacaaactgat

SEQ ID NO: 91061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaattaggtgacaaactga

SEQ ID NO: 91062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctttcaattaggtgacaaa

SEQ ID NO: 91063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctttcaattaggtgacaa

SEQ ID NO: 91064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaatttagctttcaattag

SEQ ID NO: 91065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttgaaaatttagctttcaa

SEQ ID NO: 91066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttgaaaatttagctttca

SEQ ID NO: 91067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatttggttgaaaatttag

SEQ ID NO: 91068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttaacatttggttgaaaatt

SEQ ID NO: 91069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctattaacatttggttgaaa

SEQ ID NO: 91070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctattaacatttggttgaa

SEQ ID NO: 91071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctattaacatttggttga

SEQ ID NO: 91072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttttgctattaacatttgg

SEQ ID NO: 91073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacaaacaactagttttgct

SEQ ID NO: 91074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagatattaaacaaacaact

SEQ ID NO: 91075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagatattaaacaaacaac

SEQ ID NO: 91076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcttaaagatattaaacaa

SEQ ID NO: 91077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagactatgcttaaagatat

SEQ ID NO: 91078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcagactatgcttaaagata

SEQ ID NO: 91079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgcagactatgcttaaagat

SEQ ID NO: 91080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgcagactatgcttaaaga

SEQ ID NO: 91081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttgcagactatgcttaa

SEQ ID NO: 91082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttgcagactatgctta

SEQ ID NO: 91083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatttttgcagactatgctt

SEQ ID NO: 91084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccccctttatttttgcagac

SEQ ID NO: 91085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctcccccctttatttttgc

SEQ ID NO: 91086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctcccccctttatttttg

SEQ ID NO: 91087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatggtgatttgcctccccc

SEQ ID NO: 91088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtatggtgatttgcctcccc

SEQ ID NO: 91089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtatggtgatttgcctccc

SEQ ID NO: 91090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acacacacacacacacacac

SEQ ID NO: 91091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acactcacacacacacacac

SEQ ID NO: 91092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ccacacacacactcacactc

SEQ ID NO: 91093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
accacacacacactcacact

SEQ ID NO: 91094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taccacacacacactcacac

SEQ ID NO: 91095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaattttaccacacacacac

SEQ ID NO: 91096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atactagaattttaccacac

SEQ ID NO: 91097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catactagaattttaccaca

SEQ ID NO: 91098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatactagaattttaccac

SEQ ID NO: 91099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtcattttcatactagaat

SEQ ID NO: 91100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ataaatgattgtgtcatttt

SEQ ID NO: 91101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgctcataaatgattgtgt

SEQ ID NO: 91102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgctcataaatgattgtg

SEQ ID NO: 91103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaacttcatgctcataaat

SEQ ID NO: 91104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagtggaagtaaggactgca

SEQ ID NO: 91105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttagagtggaagtaaggact

SEQ ID NO: 91106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttattagagtggaagtaagg

SEQ ID NO: 91107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccatgaagacccatcactg

SEQ ID NO: 91108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atccatgaagacccatcact

SEQ ID NO: 91109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagaggcaatgtgggctta

SEQ ID NO: 91110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggaaggttcagagaggcaa

SEQ ID NO: 91111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaggaaggttcagagaggc

SEQ ID NO: 91112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctaaggaaggttcagagag

SEQ ID NO: 91113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagcattctctaaggaaggt

SEQ ID NO: 91114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagcattctctaaggaagg

SEQ ID NO: 91115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaaatatttgaagcattc

SEQ ID NO: 91116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccccaggtacaaagggcaca

SEQ ID NO: 91117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccccaggtacaaagggcac

SEQ ID NO: 91118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtttgccccaggtacaaa

SEQ ID NO: 91119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aattgatgtttgccccaggt

SEQ ID NO: 91120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacacggtctaaattgatgt

SEQ ID NO: 91121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacacggtctaaattgatg

SEQ ID NO: 91122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtttccacacggtctaaat

SEQ ID NO: 91123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atagaaatgtagtcagatga

SEQ ID NO: 91124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agttgatagaaatgtagtca

SEQ ID NO: 91125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgagctcagttgatagaa

SEQ ID NO: 91126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtgagctcagttgataga

SEQ ID NO: 91127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaataaacatagatgcttat

SEQ ID NO: 91128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaataaacatagatgctta

SEQ ID NO: 91129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaataaacatagatgctt

SEQ ID NO: 91130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaaaataaacatagatgct

SEQ ID NO: 91131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttaaaataaacatagatg

SEQ ID NO: 91132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatattcttttaaaataaa

SEQ ID NO: 91133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaatattcttttaaaataa

SEQ ID NO: 91134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaatttaaaatattctttt

SEQ ID NO: 91135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
actatgaatttaaaatattc

SEQ ID NO: 91136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agggccagtcaatagtcact

SEQ ID NO: 91137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagggccagtcaatagtcac

SEQ ID NO: 91138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acagaaatttgagggccagt

SEQ ID NO: 91139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatcatctaacagaaatttg

SEQ ID NO: 91140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctgtatcatctaacaga

SEQ ID NO: 91141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatctgtatcatctaacag

SEQ ID NO: 91142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtttaaatctgtatcatct

SEQ ID NO: 91143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaggtttaaatctgtatca

SEQ ID NO: 91144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaggtttaaatctgtatc

SEQ ID NO: 91145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaatgataaccttgttaggt

SEQ ID NO: 91146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caaatctaaaatgataacct

SEQ ID NO: 91147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taagtgactccaaatctaaa

SEQ ID NO: 91148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atatggttataagtgactcc

SEQ ID NO: 91149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataaactaatatggttata

SEQ ID NO: 91150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gattgcataaactaatatgg

SEQ ID NO: 91151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaaaaaattggattgcata

SEQ ID NO: 91152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaaaaaattggattgcat

SEQ ID NO: 91153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagaaaaaattggattgca

SEQ ID NO: 91154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatatattttaagaaaaaa

SEQ ID NO: 91155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaaggcagtgaccacaaat

SEQ ID NO: 91156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agaaaggcagtgaccacaaa

SEQ ID NO: 91157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttagaaaggcagtgaccaca

SEQ ID NO: 91158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatgcattcttagaaaggc

SEQ ID NO: 91159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaatgcattcttagaaagg

SEQ ID NO: 91160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaggtaagtaatttgtaatg

SEQ ID NO: 91161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaggtaagtaatttgtaat

SEQ ID NO: 91162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagtgtaggtgataatgta

SEQ ID NO: 91163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcagtgtaggtgataatgt

SEQ ID NO: 91164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcagtgtaggtgataatg

SEQ ID NO: 91165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatcagtgtaggtgataat

SEQ ID NO: 91166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttatcagtgtaggtgata

SEQ ID NO: 91167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttttatcagtgtaggtga

SEQ ID NO: 91168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctcttttatcagtgtaggt

SEQ ID NO: 91169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agatgtattctctcttttat

SEQ ID NO: 91170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaatatcctgagatgtattc

SEQ ID NO: 91171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggaggtaaaattaaaatat

SEQ ID NO: 91172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caatatcatggtatgatatt

SEQ ID NO: 91173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acaatatcatggtatgatat

SEQ ID NO: 91174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacaatatcatggtatgata

SEQ ID NO: 91175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacaatatcatggtatgat

SEQ ID NO: 91176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtatttttacaatatcatgg

SEQ ID NO: 91177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtatttttacaatatcatg

SEQ ID NO: 91178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcaagcatttagtattttta

SEQ ID NO: 91179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtcaagcatttagtattttt

SEQ ID NO: 91180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgtcaagcatttagtatt

SEQ ID NO: 91181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttgtcaagcatttagtat

SEQ ID NO: 91182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttgtcaagcatttagta

SEQ ID NO: 91183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatttgtcaagcatttagt

SEQ ID NO: 91184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatttgtcaagcatttag

SEQ ID NO: 91185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttttatttgtcaagcatt

SEQ ID NO: 91186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattttttatttgtcaagca

SEQ ID NO: 91187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgattctattttttatttgt

SEQ ID NO: 91188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgattctattttttatttg

SEQ ID NO: 91189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgattctattttttattt

SEQ ID NO: 91190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaacatgaattttgtgatt

SEQ ID NO: 91191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accctggaaacatgaatttt

SEQ ID NO: 91192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaataaagcatattaacc

SEQ ID NO: 91193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagaataaagcatattaac

SEQ ID NO: 91194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccagaataaagcatatta

SEQ ID NO: 91195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataaataataaaatacaaa

SEQ ID NO: 91196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataaataataaaatacaa

SEQ ID NO: 91197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtagatatttatataaataa

SEQ ID NO: 91198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcatcaagtagtagggggtt

SEQ ID NO: 91199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaatagtgcctggcatca

SEQ ID NO: 91200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagaatagtgcctggcatc

SEQ ID NO: 91201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcttccagaatagtgcctgg

SEQ ID NO: 91202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcttccagaatagtgcctg

SEQ ID NO: 91203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acttagcttccagaatagtg

SEQ ID NO: 91204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttgacttagcttccagaata

SEQ ID NO: 91205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgttgacttagcttccag

SEQ ID NO: 91206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgttgacttagcttcca

SEQ ID NO: 91207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtcttcattgttgacttag

SEQ ID NO: 91208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caagggaacccagactatgt

SEQ ID NO: 91209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cataccaaatactccaaggg

SEQ ID NO: 91210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcataccaaatactccaagg

SEQ ID NO: 91211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgaatttgcataccaaatac

SEQ ID NO: 91212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgaatttgcataccaaata

SEQ ID NO: 91213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgaatttgcataccaaat

SEQ ID NO: 91214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagcatgcaggtattttgtg

SEQ ID NO: 91215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttacagcatgcaggtatttt

SEQ ID NO: 91216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttacagcatgcaggtattt

SEQ ID NO: 91217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgttacagcatgcaggta

SEQ ID NO: 91218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atactgcttgttacagcatg

SEQ ID NO: 91219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catactgcttgttacagcat

SEQ ID NO: 91220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcatactgcttgttacagca

SEQ ID NO: 91221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcatactgcttgttacag

SEQ ID NO: 91222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttcatactgcttgttaca

SEQ ID NO: 91223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttctttcatactgcttgtt

SEQ ID NO: 91224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtttctttcatactgcttgt

SEQ ID NO: 91225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaccttgtttctttcatac

SEQ ID NO: 91226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttggaaccttgtttctt

SEQ ID NO: 91227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgttggaaccttgtttct

SEQ ID NO: 91228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtcttgatgttggaaccttg

SEQ ID NO: 91229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcccgtgttggtcttgatgt

SEQ ID NO: 91230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaagtaggttgtcccgtgtt

SEQ ID NO: 91231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaaaagtaggttgtcccgt

SEQ ID NO: 91232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaaaagtaggttgtcccg

SEQ ID NO: 91233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcatcttgttaaaagtagg

SEQ ID NO: 91234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcatcttgttaaaagtag

SEQ ID NO: 91235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatcatcttgttaaaagta

SEQ ID NO: 91236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgatcatcttgttaaaagt

SEQ ID NO: 91237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagatcatttttgatcat

SEQ ID NO: 91238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaagatcatttttgatca

SEQ ID NO: 91239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggaaagatcatttttgatc

SEQ ID NO: 91240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttggaaagatcatttttg

SEQ ID NO: 91241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttggaaagatcattttt

SEQ ID NO: 91242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttggaaagatcatttt

SEQ ID NO: 91243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttttggaaagatcattt

SEQ ID NO: 91244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttttggaaagatcatt

SEQ ID NO: 91245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttgttttggaaagatcat

SEQ ID NO: 91246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gaggtttttttgttttggaa

SEQ ID NO: 91247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aactcgaggtttttttgttt

SEQ ID NO: 91248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatctcaactcgaggttttt

SEQ ID NO: 91249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatctcaactcgaggtttt

SEQ ID NO: 91250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaatctcaactcgaggttt

SEQ ID NO: 91251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactttaaatctcaactcga

SEQ ID NO: 91252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaactttaaatctcaactcg

SEQ ID NO: 91253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttaaactttaaatctcaact

SEQ ID NO: 91254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttaaactttaaatctcaac

SEQ ID NO: 91255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttcttaaactttaaatctc

SEQ ID NO: 91256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccttcttaaactttaaat

SEQ ID NO: 91257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actccttcttaaactttaaa

SEQ ID NO: 91258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgcgtgcttactccttctta

SEQ ID NO: 91259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgcgtgcttactccttct

SEQ ID NO: 91260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aactctatgcgtgcttactc

SEQ ID NO: 91261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccaatgcctgaactctatgc

SEQ ID NO: 91262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcccaatgcctgaactcta

SEQ ID NO: 91263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaatgctgttcccaatgcct

SEQ ID NO: 91264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaatgctgttcccaatgcc

SEQ ID NO: 91265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaatgctgttcccaatgc

SEQ ID NO: 91266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcaaatgctgttcccaatg

SEQ ID NO: 91267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggccttttcaaatgctgtt

SEQ ID NO: 91268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaggccttttcaaatgctgt

SEQ ID NO: 91269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaggccttttcaaatgctg

SEQ ID NO: 91270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttaaggccttttcaaatgc

SEQ ID NO: 91271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacacatgaaacaatagca

SEQ ID NO: 91272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccaggtcgtggctaaaaca

SEQ ID NO: 91273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgcccaggtcgtggctaaa

SEQ ID NO: 91274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aggtgctcctgcccaggtcg

SEQ ID NO: 91275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attaaggtgctcctgcccag

SEQ ID NO: 91276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcattaaggtgctcctgccc

SEQ ID NO: 91277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcattaaggtgctcctgcc

SEQ ID NO: 91278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctcattaaggtgctcctg

SEQ ID NO: 91279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttctcattaaggtgctcc

SEQ ID NO: 91280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctcttctcattaaggtgc

SEQ ID NO: 91281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accagaacctattctcttct

SEQ ID NO: 91282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caacctcaccagaacctatt

SEQ ID NO: 91283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccaacctcaccagaaccta

SEQ ID NO: 91284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctccaacctcaccagaacc

SEQ ID NO: 91285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctccaacctcaccagaac

SEQ ID NO: 91286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcccttctctccaacctcac

SEQ ID NO: 91287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtcccttctctccaacctc

SEQ ID NO: 91288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttctgtcccttctctccaac

SEQ ID NO: 91289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttctgtcccttctctcca

SEQ ID NO: 91290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgttctgtcccttctctc

SEQ ID NO: 91291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctctgttctgtcccttct

SEQ ID NO: 91292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actctctgttctgtcccttc

SEQ ID NO: 91293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcatatggtttactctctg

SEQ ID NO: 91294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcagcatatggtttactct

SEQ ID NO: 91295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcagcatatggtttactc

SEQ ID NO: 91296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctcagcatatggtttact

SEQ ID NO: 91297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcaacaacagtaaatgcctt

SEQ ID NO: 91298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaaaaaaaaaaagaggaa

SEQ ID NO: 91299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaaaaaaaaaaagagga

SEQ ID NO: 91300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catttaaaaaaaaaaaaaaa

SEQ ID NO: 91301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acaactgcatttaaaaaaaa

SEQ ID NO: 91302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctcacaactgcatttaaaa

SEQ ID NO: 91303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaaacattggctcacaact

SEQ ID NO: 91304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccctaacaaacattggctca

SEQ ID NO: 91305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcccctaacaaacattgg

SEQ ID NO: 91306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tacaaagcaataccatcctg

SEQ ID NO: 91307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatacaaagcaataccatcc

SEQ ID NO: 91308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctatacaaagcaataccat

SEQ ID NO: 91309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctctatacaaagcaata

SEQ ID NO: 91310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caattcattctctatacaaa

SEQ ID NO: 91311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccctgcaattcattctctat

SEQ ID NO: 91312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcccctgcaattcattctct

SEQ ID NO: 91313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcccctgcaattcattctc

SEQ ID NO: 91314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctcccctgcaattcattct

SEQ ID NO: 91315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taattttctcccctgcaatt

SEQ ID NO: 91316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtaattttctcccctgcaa

SEQ ID NO: 91317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtaattttctcccctgca

SEQ ID NO: 91318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacttctgtaattttctccc

SEQ ID NO: 91319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tccacttctgtaattttctc

SEQ ID NO: 91320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catatcaatctctccacttc

SEQ ID NO: 91321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccacagcctccatatcaatc

SEQ ID NO: 91322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaatcctgccacagcctcca

SEQ ID NO: 91323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaatcctgccacagcctcc

SEQ ID NO: 91324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttggaatcctgccacagcc

SEQ ID NO: 91325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttggaatcctgccacagc

SEQ ID NO: 91326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggtcatcatcataatttac

SEQ ID NO: 91327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttcaggtcatcatcataat

SEQ ID NO: 91328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cacggccaccaaattagttc

SEQ ID NO: 91329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatctacacggccaccaaat

SEQ ID NO: 91330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtatctacacggccaccaa

SEQ ID NO: 91331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtatctacacggccacca

SEQ ID NO: 91332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgtatctacacggccacc

SEQ ID NO: 91333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctgtatctacacggccac

SEQ ID NO: 91334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttctgtatctacacggcc

SEQ ID NO: 91335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accctcttttctgtatctac

SEQ ID NO: 91336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attcaccctcttttctgtat

SEQ ID NO: 91337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcattcaccctcttttctgt

SEQ ID NO: 91338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatgcctctcattcaccct

SEQ ID NO: 91339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atcatacgtctcagatgcct

SEQ ID NO: 91340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catcatacgtctcagatgcc

SEQ ID NO: 91341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcatcatacgtctcagat

SEQ ID NO: 91342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttcatcatacgtctcag

SEQ ID NO: 91343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatttcatcatacgtctca

SEQ ID NO: 91344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctatttcatcatacgtc

SEQ ID NO: 91345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atttctatttcatcatacgt

SEQ ID NO: 91346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaaacttatttctatttca

SEQ ID NO: 91347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctcccaaacttatttctat

SEQ ID NO: 91348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctcccaaacttatttcta

SEQ ID NO: 91349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaatcttatctcccaaact

SEQ ID NO: 91350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagtagatctatcaatctt

SEQ ID NO: 91351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcctgtaagtagatctat

SEQ ID NO: 91352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccagcctgtaagtagatcta

SEQ ID NO: 91353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccagcctgtaagtagatct

SEQ ID NO: 91354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agccctttccagcctgtaag

SEQ ID NO: 91355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagccctttccagcctgtaa

SEQ ID NO: 91356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
catttcagccctttccagcc

SEQ ID NO: 91357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctccatttcagccctttcca

SEQ ID NO: 91358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttactccatttcagcccttt

SEQ ID NO: 91359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attactccatttcagccctt

SEQ ID NO: 91360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttattactccatttcagcc

SEQ ID NO: 91361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttattactccatttcagc

SEQ ID NO: 91362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttccttattactccatttca

SEQ ID NO: 91363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcttccttattactccattt

SEQ ID NO: 91364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctcttccttattactcca

SEQ ID NO: 91365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attgctctcttccttattac

SEQ ID NO: 91366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gattgctctcttccttatta

SEQ ID NO: 91367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgattgctctcttccttatt

SEQ ID NO: 91368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatcacctttgattgctct

SEQ ID NO: 91369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accatccaagtattgaaatc

SEQ ID NO: 91370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caccatccaagtattgaaat

SEQ ID NO: 91371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataaatgccttcaccatcc

SEQ ID NO: 91372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgaataaatgccttcacc

SEQ ID NO: 91373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attatctgaataaatgcctt

SEQ ID NO: 91374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattatctgaataaatgcct

SEQ ID NO: 91375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccatcttcattatctgaata

SEQ ID NO: 91376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcccatcttcattatctga

SEQ ID NO: 91377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctcccatcttcattatctg

SEQ ID NO: 91378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcctcccatcttcattatct

SEQ ID NO: 91379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttcctcccatcttcattat

SEQ ID NO: 91380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agattctttcctcccatctt

SEQ ID NO: 91381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctcagattctttcctccca

SEQ ID NO: 91382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtctcagattctttcctcc

SEQ ID NO: 91383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaactctgtctcagattctt

SEQ ID NO: 91384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctaaaactctgtctcagat

SEQ ID NO: 91385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccctaaaactctgtctcaga

SEQ ID NO: 91386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccctaaaactctgtctcag

SEQ ID NO: 91387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgactttccctaaaactctg

SEQ ID NO: 91388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgactttccctaaaactct

SEQ ID NO: 91389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatgtcataatgataataat

SEQ ID NO: 91390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatgtcataatgataata

SEQ ID NO: 91391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtaaatggaacattctag

SEQ ID NO: 91392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgatgtaaatggaacattc

SEQ ID NO: 91393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgatgtaaatggaacatt

SEQ ID NO: 91394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtttattgatgtaaatgg

SEQ ID NO: 91395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagtttattgatgtaaatg

SEQ ID NO: 91396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaaagagcttaaagtttat

SEQ ID NO: 91397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaaaagagcttaaagttta

SEQ ID NO: 91398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agacaagtcatgatcttgta

SEQ ID NO: 91399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taagacaagtcatgatcttg

SEQ ID NO: 91400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaagacaagtcatgatctt

SEQ ID NO: 91401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaagacaagtcatgatct

SEQ ID NO: 91402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctaagacaagtcatgatc

SEQ ID NO: 91403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatggtacttttctaagaca

SEQ ID NO: 91404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatggtacttttctaagac

SEQ ID NO: 91405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaggatttatatggtactt

SEQ ID NO: 91406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgcaaaagagtgtgaagtgc

SEQ ID NO: 91407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttatgcaaaagagtgtgaa

SEQ ID NO: 91408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagttatgcaaaagagtgt

SEQ ID NO: 91409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattagttatgcaaaagag

SEQ ID NO: 91410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcctattagttatgcaaaa

SEQ ID NO: 91411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattcctattagttatgcaa

SEQ ID NO: 91412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctattcctattagttatgca

SEQ ID NO: 91413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tccaatttctattcctatta

SEQ ID NO: 91414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atccaatttctattcctatt

SEQ ID NO: 91415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatccaatttctattcctat

SEQ ID NO: 91416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatccaatttctattccta

SEQ ID NO: 91417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttatccaatttctattcct

SEQ ID NO: 91418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttttatccaatttctatt

SEQ ID NO: 91419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgaataataaaatctatt

SEQ ID NO: 91420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgaataataaaatctat

SEQ ID NO: 91421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacatgaataataaaatcta

SEQ ID NO: 91422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttacatgaataataaaa

SEQ ID NO: 91423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattttacatgaataataaa

SEQ ID NO: 91424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcattttacatgaataataa

SEQ ID NO: 91425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcattttacatgaataata

SEQ ID NO: 91426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggcaaggaaaaaagtagaa

SEQ ID NO: 91427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtggcaaggaaaaaagtag

SEQ ID NO: 91428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctgtggcaaggaaaaaagt

SEQ ID NO: 91429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctgtggcaaggaaaaaag

SEQ ID NO: 91430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctgtggcaaggaaaaaa

SEQ ID NO: 91431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atataatcaacccactttct

SEQ ID NO: 91432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatataatcaacccactttc

SEQ ID NO: 91433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaatataatcaacccact

SEQ ID NO: 91434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttaatataatcaacccac

SEQ ID NO: 91435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttatttaatataatcaacc

SEQ ID NO: 91436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttatttaatataatcaa

SEQ ID NO: 91437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagagcaatcagtagggt

SEQ ID NO: 91438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaagcaaaatagataaaca

SEQ ID NO: 91439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaagcaaaatagataaac

SEQ ID NO: 91440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agtttcagaagcaaaataga

SEQ ID NO: 91441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgctgagtttcagaagcaaa

SEQ ID NO: 91442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtgctgagtttcagaagc

SEQ ID NO: 91443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttgctgtgctgagtttcaga

SEQ ID NO: 91444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctgttgctgtgctgagttt

SEQ ID NO: 91445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctacctgttgctgtgctgag

SEQ ID NO: 91446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actacctgttgctgtgctga

SEQ ID NO: 91447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactacctgttgctgtgctg

SEQ ID NO: 91448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactacctgttgctgtgct

SEQ ID NO: 91449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttttactacctgttgct

SEQ ID NO: 91450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtttttactacctgttg

SEQ ID NO: 91451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctatgtttttactacctgtt

SEQ ID NO: 91452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtaatgcttctatgtttt

SEQ ID NO: 91453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtggtaatgcttctatgtt

SEQ ID NO: 91454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtggtaatgcttctatgt

SEQ ID NO: 91455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catataatcatgggagccct

SEQ ID NO: 91456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggcctgcatataatcatgg

SEQ ID NO: 91457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccctagggcctgcatataat

SEQ ID NO: 91458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccctagggcctgcatataa

SEQ ID NO: 91459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcccctagggcctgcatata

SEQ ID NO: 91460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctttcccctagggcctgcat

SEQ ID NO: 91461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggcctcctttcccctagggc

SEQ ID NO: 91462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggcctcctttcccctaggg

SEQ ID NO: 91463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaaaagcatcttgggcctc

SEQ ID NO: 91464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgccaaaagcatcttgggcc

SEQ ID NO: 91465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgccaaaagcatcttggg

SEQ ID NO: 91466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctctctgccaaaagcatct

SEQ ID NO: 91467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagaagaaagatgagtcagg

SEQ ID NO: 91468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacagaagaaagatgagtca

SEQ ID NO: 91469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctacagaagaaagatgagtc

SEQ ID NO: 91470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgcttctacagaagaaaga

SEQ ID NO: 91471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acagagtacctgatgcttct

SEQ ID NO: 91472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggctcacagagtacctgatg

SEQ ID NO: 91473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggtgcagggctaggctcac

SEQ ID NO: 91474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatggtgcagggctaggct

SEQ ID NO: 91475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attcctatggtgcagggcta

SEQ ID NO: 91476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gattcctatggtgcagggct

SEQ ID NO: 91477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gatatatgatatgccttgat

SEQ ID NO: 91478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtgactggatatatgata

SEQ ID NO: 91479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acagtgactggatatatgat

SEQ ID NO: 91480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacagtgactggatatatga

SEQ ID NO: 91481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacagtgactggatatatg

SEQ ID NO: 91482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtgatgtgtttttacagtg

SEQ ID NO: 91483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgggactcagtgatgtgttt

SEQ ID NO: 91484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcagttgtgggactcagtg

SEQ ID NO: 91485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agtaagccactgtgcagttg

SEQ ID NO: 91486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagtaagccactgtgcagtt

SEQ ID NO: 91487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttaagtaagccactgtgca

SEQ ID NO: 91488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttaagtaagccactgtgc

SEQ ID NO: 91489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaggaggtttccttaagta

SEQ ID NO: 91490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaggaggtttccttaagt

SEQ ID NO: 91491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tagaggtttaaaaggaggtt

SEQ ID NO: 91492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtagaggtttaaaaggaggt

SEQ ID NO: 91493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtagaggtttaaaaggagg

SEQ ID NO: 91494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattttgtagaggtttaaa

SEQ ID NO: 91495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaattttgtagaggtttaa

SEQ ID NO: 91496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaattttgtagaggttta

SEQ ID NO: 91497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaattttgtagaggttt

SEQ ID NO: 91498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaattttgtagaggtt

SEQ ID NO: 91499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agacaagttttttaaaattt

SEQ ID NO: 91500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagacaagttttttaaaatt

SEQ ID NO: 91501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gcttaagacaagttttttaa

SEQ ID NO: 91502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggcttaagacaagtttttta

SEQ ID NO: 91503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atagtttggcttaagacaag

SEQ ID NO: 91504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcaactgatagtttggctt

SEQ ID NO: 91505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggcaactgatagtttggct

SEQ ID NO: 91506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttaggcaactgatagtttg

SEQ ID NO: 91507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatttaggcaactgatagtt

SEQ ID NO: 91508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgtaaagaagaatgtgccc

SEQ ID NO: 91509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatgtaaagaagaatgtgcc

SEQ ID NO: 91510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gacagaatatggtatttgat

SEQ ID NO: 91511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagacagaatatggtatttg

SEQ ID NO: 91512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcaacaacaaaactctagac

SEQ ID NO: 91513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atcaacaacaaaactctaga

SEQ ID NO: 91514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcttatcaacaacaaaactc

SEQ ID NO: 91515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gactagcttatcaacaacaa

SEQ ID NO: 91516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagactagcttatcaacaa

SEQ ID NO: 91517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgattgttagactagctta

SEQ ID NO: 91518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catgattgttagactagctt

SEQ ID NO: 91519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcatgattgttagactagct

SEQ ID NO: 91520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtcgcaaattttcatgatt

SEQ ID NO: 91521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atccctgtgtcgcaaatttt

SEQ ID NO: 91522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctgatccctgtgtcgcaaa

SEQ ID NO: 91523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctgatccctgtgtcgcaa

SEQ ID NO: 91524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtcttatctgatccctgtgt

SEQ ID NO: 91525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaagctagtcttatctgatc

SEQ ID NO: 91526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaagctagtcttatctgat

SEQ ID NO: 91527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtttgaaagctagtcttatc

SEQ ID NO: 91528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attagtttgaaagctagtct

SEQ ID NO: 91529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgattagtttgaaagctag

SEQ ID NO: 91530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaattattgattagtttga

SEQ ID NO: 91531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaattattgattagtttg

SEQ ID NO: 91532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaattattgattagttt

SEQ ID NO: 91533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaattattgattagtt

SEQ ID NO: 91534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaaaaattattgattagt

SEQ ID NO: 91535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtgagattttttaaaaat

SEQ ID NO: 91536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattatggtgagatttttt

SEQ ID NO: 91537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ataattatggtgagattttt

SEQ ID NO: 91538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttataattatggtgagattt

SEQ ID NO: 91539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttataattatggtgagatt

SEQ ID NO: 91540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttataattatggtgagat

SEQ ID NO: 91541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttataattatggtgaga

SEQ ID NO: 91542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttataattatggtgag

SEQ ID NO: 91543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taattttttcttataattat

SEQ ID NO: 91544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataattttttcttataatta

SEQ ID NO: 91545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaagtttataattttttc

SEQ ID NO: 91546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaagtttataatttttt

SEQ ID NO: 91547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttaaaaaagtttataattt

SEQ ID NO: 91548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactatttaaaaaagtttat

SEQ ID NO: 91549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccactatttaaaaaagttta

SEQ ID NO: 91550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccactatttaaaaaagttt

SEQ ID NO: 91551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttccactatttaaaaaagtt

SEQ ID NO: 91552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttccactatttaaaaaagt

SEQ ID NO: 91553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agattttttccactatttaa

SEQ ID NO: 91554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagattttttccactattta

SEQ ID NO: 91555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcagattttttccactatt

SEQ ID NO: 91556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaattcttcagattttttc

SEQ ID NO: 91557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcaaattcttcagatttt

SEQ ID NO: 91558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgcaaattcttcagattt

SEQ ID NO: 91559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgcaaattcttcagatt

SEQ ID NO: 91560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attttattgcaaattcttca

SEQ ID NO: 91561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcattttattgcaaattct

SEQ ID NO: 91562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aactgttcattttattgcaa

SEQ ID NO: 91563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttaaactgttcattttattg

SEQ ID NO: 91564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaccaaatccaattatta

SEQ ID NO: 91565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tataaactgcaaaccaaatc

SEQ ID NO: 91566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atataaactgcaaaccaaat

SEQ ID NO: 91567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatataaactgcaaaccaaa

SEQ ID NO: 91568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttatataaactgcaaacc

SEQ ID NO: 91569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acatcaatataaacctattt

SEQ ID NO: 91570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacatcaatataaacctatt

SEQ ID NO: 91571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taacatcaatataaacctat

SEQ ID NO: 91572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctttaacatcaatataaacc

SEQ ID NO: 91573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctttaacatcaatataaac

SEQ ID NO: 91574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctttaacatcaatataaa

SEQ ID NO: 91575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgctttaacatcaatataa

SEQ ID NO: 91576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatttttgctttaacatca

SEQ ID NO: 91577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ataatttttgctttaacatc

SEQ ID NO: 91578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tataatttttgctttaacat

SEQ ID NO: 91579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aatatattttataatttttg

SEQ ID NO: 91580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaatatattttataattttt

SEQ ID NO: 91581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttaaatatattttataatt

SEQ ID NO: 91582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttatttaaatatattttata

SEQ ID NO: 91583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttatttaaatatattttat

SEQ ID NO: 91584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttgttatttaaatatattt

SEQ ID NO: 91585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttgttatttaaatatatt

SEQ ID NO: 91586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccttgttatttaaatatat

SEQ ID NO: 91587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttccttgttatttaaatat

SEQ ID NO: 91588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttccttgttatttaaata

SEQ ID NO: 91589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttccttgttatttaaat

SEQ ID NO: 91590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctttccttgttatttaa

SEQ ID NO: 91591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttctttccttgttattt

SEQ ID NO: 91592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctttctttccttgttatt

SEQ ID NO: 91593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctttctttccttgttat

SEQ ID NO: 91594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctctttctttccttgtt

SEQ ID NO: 91595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttctctttctttccttgt

SEQ ID NO: 91596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctttctctttctttccttg

SEQ ID NO: 91597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagacaagataaagattttc

SEQ ID NO: 91598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cctgtagacaagataaagat

SEQ ID NO: 91599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccctgtagacaagataaaga

SEQ ID NO: 91600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccctgtagacaagataaa

SEQ ID NO: 91601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttccctgtagacaagataa

SEQ ID NO: 91602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcttccctgtagacaagat

SEQ ID NO: 91603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcttccctgtagacaaga

SEQ ID NO: 91604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttcttcttccctgtagaca

SEQ ID NO: 91605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttcttcttccctgtaga

SEQ ID NO: 91606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatttcttcttccctgtag

SEQ ID NO: 91607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatttcttcttccctgta

SEQ ID NO: 91608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctatttcttcttccctgt

SEQ ID NO: 91609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttctatttcttcttccct

SEQ ID NO: 91610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttttctatttcttcttc

SEQ ID NO: 91611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttattcttttctatttcttc

SEQ ID NO: 91612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attattcttttctatttctt

SEQ ID NO: 91613 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaacatatttattattct

SEQ ID NO: 91614 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagaaacatatttattattc

SEQ ID NO: 91615 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcagaaacatatttattatt

SEQ ID NO: 91616 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcagaaacatatttattat

SEQ ID NO: 91617 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttcagaaacatatttatt

SEQ ID NO: 91618 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttcttttcagaaacatat

SEQ ID NO: 91619 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaagttcagttcttttcag

SEQ ID NO: 91620 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aataggaagtcagtgttggg

SEQ ID NO: 91621 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgaataggaagtcagtgtt

SEQ ID NO: 91622 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcagttactgaataggaagt

SEQ ID NO: 91623 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcagttactgaataggaag

SEQ ID NO: 91624 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggaagtgatagcttgtca

SEQ ID NO: 91625 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaggaagtgatagcttgtc

SEQ ID NO: 91626 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcaaggaagtgatagcttgt

SEQ ID NO: 91627 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgtcagtaagataaaagcc

SEQ ID NO: 91628 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agaagctagtgtcagtaaga

SEQ ID NO: 91629 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagaagctagtgtcagtaag

SEQ ID NO: 91630 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagaagctagtgtcagtaa

SEQ ID NO: 91631 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagaagctagtgtcagta

SEQ ID NO: 91632 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggggggtttttaagaagcta

SEQ ID NO: 91633 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggggggtttttaagaagct

SEQ ID NO: 91634 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
catgagaaacttaggggggt

SEQ ID NO: 91635 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acatgagaaacttagggggg

SEQ ID NO: 91636 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagcaatttacatgagaaa

SEQ ID NO: 91637 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgttaagagcaatttacat

SEQ ID NO: 91638 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgatgttaagagcaatttac

SEQ ID NO: 91639 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctctgatgttaagagcaatt

SEQ ID NO: 91640 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatctactctgatgttaaga

SEQ ID NO: 91641 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atagattatatctactctga

SEQ ID NO: 91642 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gagcgttcatagattatatc

SEQ ID NO: 91643 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agttggagcgttcatagatt

SEQ ID NO: 91644 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aagttggagcgttcatagat

SEQ ID NO: 91645 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taagttggagcgttcataga

SEQ ID NO: 91646 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaagttggagcgttcatag

SEQ ID NO: 91647 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttaagttggagcgttcata

SEQ ID NO: 91648 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttaagttggagcgttcat

SEQ ID NO: 91649 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttaagttggagcgttca

SEQ ID NO: 91650 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttaagttggagcgttc

SEQ ID NO: 91651 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttaagttggagcgtt

SEQ ID NO: 91652 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttttttttaagttggagcgt

SEQ ID NO: 91653 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttttttttaagttggagcg

SEQ ID NO: 91654 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttttttttttttaagttgg

SEQ ID NO: 91655 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttttttttttttaagttg

SEQ ID NO: 91656 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttttttttttttaagtt

SEQ ID NO: 91657 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttagttttttttttttaa

SEQ ID NO: 91658 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
attattttagtttttttttt

SEQ ID NO: 91659 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actcattattttagtttttt

SEQ ID NO: 91660 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactcattattttagttttt

SEQ ID NO: 91661 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtaaacatttcactcatt

SEQ ID NO: 91662 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgattatagtaaacatttca

SEQ ID NO: 91663 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgattatagtaaacatttc

SEQ ID NO: 91664 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtgattatagtaaacattt

SEQ ID NO: 91665 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgtgattatagtaaacatt

SEQ ID NO: 91666 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgccagtttttgtgattat

SEQ ID NO: 91667 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaaacattaatgccagtttt

SEQ ID NO: 91668 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagacaaaaatcagaacaag

SEQ ID NO: 91669 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tattcaagacaaaaatcaga

SEQ ID NO: 91670 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atattcaagacaaaaatcag

SEQ ID NO: 91671 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gtgccttatattcaagacaa

SEQ ID NO: 91672 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgtgccttatattcaagaca

SEQ ID NO: 91673 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgtgccttatattcaagac

SEQ ID NO: 91674 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaaaaatggatattttcg

SEQ ID NO: 91675 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggaaaaaatggatattttc

SEQ ID NO: 91676 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taggaaaaaatggatatttt

SEQ ID NO: 91677 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaggaaaaaatggatattt

SEQ ID NO: 91678 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cttttaggaaaaaatggata

SEQ ID NO: 91679 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acttttaggaaaaaatggat

SEQ ID NO: 91680 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atttacttttaggaaaaaat

SEQ ID NO: 91681 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaactcatttacttttag

SEQ ID NO: 91682 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggaaactcatttactttta

SEQ ID NO: 91683 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aacttgggaaactcatttac

SEQ ID NO: 91684 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcgaattcaacttgggaaac

SEQ ID NO: 91685 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcgaattcaacttgggaaa

SEQ ID NO: 91686 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcgaattcaacttgggaa

SEQ ID NO: 91687 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttatcgaattcaacttggga

SEQ ID NO: 91688 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttatcgaattcaacttggg

SEQ ID NO: 91689 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
actttttatcgaattcaact

SEQ ID NO: 91690 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aactttttatcgaattcaac

SEQ ID NO: 91691 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taactttttatcgaattcaa

SEQ ID NO: 91692 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttaactttttatcgaattca

SEQ ID NO: 91693 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaaaagatgcagaatcctt

SEQ ID NO: 91694 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagtgaaattcagaaaagat

SEQ ID NO: 91695 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagtgaaattcagaaaaga

SEQ ID NO: 91696 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tatagtgaaattcagaaaag

SEQ ID NO: 91697 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gaataagcactttatagtga

SEQ ID NO: 91698 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgaataagcactttatagtg

SEQ ID NO: 91699 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcgaataagcactttatagt

SEQ ID NO: 91700 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcgaataagcactttatag

SEQ ID NO: 91701 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcgaataagcactttata

SEQ ID NO: 91702 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttttcgaataagcacttt

SEQ ID NO: 91703 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttttcgaataagcactt

SEQ ID NO: 91704 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttattttttcgaataagca

SEQ ID NO: 91705 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttattttttcgaataagc

SEQ ID NO: 91706 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttatttattttttcgaata

SEQ ID NO: 91707 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcgcagattatttatttat

SEQ ID NO: 91708 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcagcgcagattatttattt

SEQ ID NO: 91709 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcagcgcagattatttatt

SEQ ID NO: 91710 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctcagcgcagattattt

SEQ ID NO: 91711 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccctatttctcagcgcaga

SEQ ID NO: 91712 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcccctatttctcagcgca

SEQ ID NO: 91713 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
acaggacagctctgccccta

SEQ ID NO: 91714 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agagcacacaaacacaaata

SEQ ID NO: 91715 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagagcacacaaacacaaat

SEQ ID NO: 91716 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggggacagaaaagaacccc

SEQ ID NO: 91717 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcagatacaacctgtgggga

SEQ ID NO: 91718 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agcagatacaacctgtgggg

SEQ ID NO: 91719 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcgtgcagaaccagcttag

SEQ ID NO: 91720 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaagctgagcgtgcagaac

SEQ ID NO: 91721 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccatctgcaaagctgagcgt

SEQ ID NO: 91722 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cccatctgcaaagctgagcg

SEQ ID NO: 91723 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttcccatctgcaaagct

SEQ ID NO: 91724 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgagcaaaaagcatgtgctg

SEQ ID NO: 91725 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgagcaaaaagcatgtgct

SEQ ID NO: 91726 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tacgagcaaaaagcatgtgc

SEQ ID NO: 91727 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttacgagcaaaaagcatgtg

SEQ ID NO: 91728 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttacgagcaaaaagcatgt

SEQ ID NO: 91729 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acattttttacgagcaaaaa

SEQ ID NO: 91730 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaggggcagctcacattttt

SEQ ID NO: 91731 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattcaaggggcagctcaca

SEQ ID NO: 91732 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caattcaaggggcagctcac

SEQ ID NO: 91733 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gatggacttcaattcaaggg

SEQ ID NO: 91734 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagatggacttcaattcaa

SEQ ID NO: 91735 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcagagttgttagatggact

SEQ ID NO: 91736 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgctagcagagttgttagat

SEQ ID NO: 91737 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgctagcagagttgttaga

SEQ ID NO: 91738 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttacgctagcagagttgtt

SEQ ID NO: 91739 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtttacgctagcagagttg

SEQ ID NO: 91740 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgtttacgctagcagagtt

SEQ ID NO: 91741 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctgtttacgctagcaga

SEQ ID NO: 91742 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctgtttacgctagcag

SEQ ID NO: 91743 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttctgtttacgctagca

SEQ ID NO: 91744 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttatttctgtttacgctagc

SEQ ID NO: 91745 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttttatttctgtttacgc

SEQ ID NO: 91746 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtcttttatttctgttta

SEQ ID NO: 91747 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtcttttatttctgttt

SEQ ID NO: 91748 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggtttactgtcttttatt

SEQ ID NO: 91749 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggaaaggaagggtagcaat

SEQ ID NO: 91750 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaactgtggaaaggaagggt

SEQ ID NO: 91751 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgaaactgtggaaaggaagg

SEQ ID NO: 91752 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaggttctgaaactgtgga

SEQ ID NO: 91753 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgccaggttctgaaactgt

SEQ ID NO: 91754 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgccaggttctgaaactg

SEQ ID NO: 91755 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgggtttgctgccaggttct

SEQ ID NO: 91756 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtgggtttgctgccaggtt

SEQ ID NO: 91757 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actctgtgggtttgctgcca

SEQ ID NO: 91758 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactctgtgggtttgctgcc

SEQ ID NO: 91759 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgactctgtgggtttgctgc

SEQ ID NO: 91760 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcggttttgactctgtggg

SEQ ID NO: 91761 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtgcggttttgactctgt

SEQ ID NO: 91762 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggcagctcctgtgcggtttt

SEQ ID NO: 91763 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gatagctgggcagctcctgt

SEQ ID NO: 91764 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgatagctgggcagctcctg

SEQ ID NO: 91765 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttcgatagctgggcagctc

SEQ ID NO: 91766 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagcgtagttatttcgata

SEQ ID NO: 91767 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagcaatgggaggaagaagg

SEQ ID NO: 91768 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
accgggtggttccagcaatg

SEQ ID NO: 91769 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaccgggtggttccagcaat

SEQ ID NO: 91770 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaagaagagaggggagaag

SEQ ID NO: 91771 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgccacctggaaagaagaga

SEQ ID NO: 91772 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattacgccacctggaaaga

SEQ ID NO: 91773 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaccctgtattacgccacc

SEQ ID NO: 91774 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggaaccctgtattacgcca

SEQ ID NO: 91775 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggttctggaaccctgtatta

SEQ ID NO: 91776 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatctcggttctggaaccc

SEQ ID NO: 91777 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacatctcggttctggaacc

SEQ ID NO: 91778 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacatctcggttctggaac

SEQ ID NO: 91779 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttcacatctcggttctgg

SEQ ID NO: 91780 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtctattttcacatctcgg

SEQ ID NO: 91781 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaccgccacacccacctgtg

SEQ ID NO: 91782 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gcctcaaccgccacacccac

SEQ ID NO: 91783 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gcccgtgctcgcctcaaccg

SEQ ID NO: 91784 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cgcccgtgctcgcctcaacc

SEQ ID NO: 91785 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcgcccgtgctcgcctcaac

SEQ ID NO: 91786 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggtctttcgcccgtgctcgc

SEQ ID NO: 91787 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggggaggggaggagaagcc

SEQ ID NO: 91788 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtggggaggggaggagaag

SEQ ID NO: 91789 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgtggggaggggaggagaa

SEQ ID NO: 91790 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttctgtggggaggggagga

SEQ ID NO: 91791 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgcttctgtggggagggga

SEQ ID NO: 91792 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgcttctgtggggagggg

SEQ ID NO: 91793 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgcttctgtggggaggg

SEQ ID NO: 91794 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgctgcttctgtggggagg

SEQ ID NO: 91795 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttttgctgcttctgtgggga

SEQ ID NO: 91796 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttttgctgcttctgtgggg

SEQ ID NO: 91797 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttttgctgcttctgtggg

SEQ ID NO: 91798 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttttgctgcttctgtgg

SEQ ID NO: 91799 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caagtaagtgccttttcttt

SEQ ID NO: 91800 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggttgcaagtaagtgccttt

SEQ ID NO: 91801 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtggggatgatcggcgggc

SEQ ID NO: 91802 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caggtgcactgggtggggat

SEQ ID NO: 91803 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcaggtgcactgggtgggg

SEQ ID NO: 91804 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagccagattctgcaggtgc

SEQ ID NO: 91805 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctggagccagattctgcagg

SEQ ID NO: 91806 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcctggagccagattctgca

SEQ ID NO: 91807 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agagagcgccggggaaggag

SEQ ID NO: 91808 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcaacaggagcccagagaa

SEQ ID NO: 91809 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcggcaggcgtcccctgagc

SEQ ID NO: 91810 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctagcggcaggcgtcccctg

SEQ ID NO: 91811 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtgccagtggctgctagcg

SEQ ID NO: 91812 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gcctgggtgccagtggctgc

SEQ ID NO: 91813 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggctagcctgggtgccagtg

SEQ ID NO: 91814 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aggctgggctagcctgggtg

SEQ ID NO: 91815 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggctgaggctgggctagcct

SEQ ID NO: 91816 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cgccagctcggctgaggctg

SEQ ID NO: 91817 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caattccgccagctcggctg

SEQ ID NO: 91818 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaattccgccagctcggct

SEQ ID NO: 91819 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccaattccgccagctcggc

SEQ ID NO: 91820 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcggctttccaattccgcca

SEQ ID NO: 91821 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagcggcggctgtcggcttt

SEQ ID NO: 91822 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caggcggtcgccagcgctcc

SEQ ID NO: 91823 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcaggcggtcgccagcgctc

SEQ ID NO: 91824 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cttgcaggcggtcgccagcg

SEQ ID NO: 91825 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcaggaggggcgcagtctgc

SEQ ID NO: 91826 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacgggcgcgccctggcagg

SEQ ID NO: 91827 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cctccacgggcgcgccctgg

SEQ ID NO: 91828 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacctccacgggcgcgccc

SEQ ID NO: 91829 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggggaggcggggctgctacc

SEQ ID NO: 91830 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctcggggaggcggggctg

SEQ ID NO: 91831 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggaggagtggaggaggcaaa

SEQ ID NO: 91832 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cgccgcccgcaggagtggag

SEQ ID NO: 91833 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtccccgccctgcgccgcc

SEQ ID NO: 91834 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctgggtccccgccctgcgc

SEQ ID NO: 91835 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagcgtcgccaccaccgcgc

SEQ ID NO: 91836 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gcgcatggtgcagaggctac

SEQ ID NO: 91837 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttagcgcatggtgcagaggc

SEQ ID NO: 91838 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattagcgcatggtgcagag

SEQ ID NO: 91839 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctattagcgcatggtgcaga

SEQ ID NO: 91840 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cgccttctattagcgcatgg

SEQ ID NO: 91841 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctccgccttctattagcgca

SEQ ID NO: 91842 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaacacacacacgccccacc

SEQ ID NO: 91843 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gacacacacacacacacact

SEQ ID NO: 91844 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctggacacacacacacacac

SEQ ID NO: 91845 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctgctggacacacacacac

SEQ ID NO: 91846 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggctgctggacacacacac

SEQ ID NO: 91847 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctggctgctggacacacaca

SEQ ID NO: 91848 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctggctgctggacacaca

SEQ ID NO: 91849 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agcaggaagggaggaaaggg

SEQ ID NO: 91850 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgagcaggaagggaggaaa

SEQ ID NO: 91851 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctgagcaggaagggagga

SEQ ID NO: 91852 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gccgattctgctgagcagga

SEQ ID NO: 91853 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggaaacattagccgattctg

SEQ ID NO: 91854 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcggaaacattagccgattc

SEQ ID NO: 91855 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctcggaaacattagccgatt

SEQ ID NO: 91856 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccaccaagccacacaaagt

SEQ ID NO: 91857 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagctccccaccaagccaca

SEQ ID NO: 91858 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tccagctccccaccaagcca

SEQ ID NO: 91859 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctccagctccccaccaagcc

SEQ ID NO: 91860 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctccagctccccaccaagc

SEQ ID NO: 91861 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctccagctccccaccaag

SEQ ID NO: 91862 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cggagtttttctccagctcc

SEQ ID NO: 91863 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctccggagtttttctccagc

SEQ ID NO: 91864 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgctccggagtttttctcca

SEQ ID NO: 91865 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctgctccggagtttttct

SEQ ID NO: 91866 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtccccacctcctctgctcc

SEQ ID NO: 91867 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccattggtccccacctcctc

SEQ ID NO: 91868 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gccattggtccccacctcct

SEQ ID NO: 91869 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgccattggtccccacctcc

SEQ ID NO: 91870 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agggctttgccattggtccc

SEQ ID NO: 91871 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccccagactcagggctttgc

SEQ ID NO: 91872 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cccagccactgccccagact

SEQ ID NO: 91873 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctccccagccactgcccca

SEQ ID NO: 91874 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctggctccccagccactgc

SEQ ID NO: 91875 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcggtgttgtctggctcccc

SEQ ID NO: 91876 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcctggcggtgttgtctggc

SEQ ID NO: 91877 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agagcccaaggtcggggagg

SEQ ID NO: 91878 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagagcccaaggtcggggag

SEQ ID NO: 91879 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcagagcccaaggtcgggg

SEQ ID NO: 91880 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gactcttcagagcccaaggt

SEQ ID NO: 91881 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccagcctagactcttcagag

SEQ ID NO: 91882 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cggaagaaaccaattcccag

SEQ ID NO: 91883 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgagcaaagccctacggaag

SEQ ID NO: 91884 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
gcggttgtgagcaaagccct

SEQ ID NO: 91885 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agcgtcaccgccccactcgc

SEQ ID NO: 91886 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gagcgtcaccgccccactcg

SEQ ID NO: 91887 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gataccggtcttgagcgtca

SEQ ID NO: 91888 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatacatatatataaaga

SEQ ID NO: 91889 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atatatacatatatataaag

SEQ ID NO: 91890 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatatatacatatatataaa

SEQ ID NO: 91891 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
attttatatatacatatata

SEQ ID NO: 91892 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aattgattttatatatacat

SEQ ID NO: 91893 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caattcaattgattttatat

SEQ ID NO: 91894 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaagacgctgcaattcaatt

SEQ ID NO: 91895 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctggaagacgctgcaattc

SEQ ID NO: 91896 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcctggaagacgctgcaatt

SEQ ID NO: 91897 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgcctggaagacgctgca

SEQ ID NO: 91898 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcttgcctggaagacgctgc

SEQ ID NO: 91899 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttgcttgcctggaagacgc

SEQ ID NO: 91900 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
gaaagaaaatgtattatttg

SEQ ID NO: 91901 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cgaaagaaaatgtattattt

SEQ ID NO: 91902 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catcttcgaaagaaaatgta

SEQ ID NO: 91903 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actgcatcttcgaaagaaaa

SEQ ID NO: 91904 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cactgcatcttcgaaagaaa

SEQ ID NO: 91905 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcactgcatcttcgaaaga

SEQ ID NO: 91906 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
attcttcactgcatcttcga

SEQ ID NO: 91907 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgattcttcactgcatcttc

SEQ ID NO: 91908 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctctgattcttcactgcatc

SEQ ID NO: 91909 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggacctcctctgattcttca

SEQ ID NO: 91910 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccacctaggacctcctctg

SEQ ID NO: 91911 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccacctaggacctcctct

SEQ ID NO: 91912 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tccccacctaggacctcctc

SEQ ID NO: 91913 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttccccacctaggacctcc

SEQ ID NO: 91914 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttccccacctaggacctc

SEQ ID NO: 91915 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cccacgtttctttccccacc

SEQ ID NO: 91916 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccccacgtttctttccccac

SEQ ID NO: 91917 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccccacgtttctttcccca

SEQ ID NO: 91918 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttccccacgtttctttcccc

SEQ ID NO: 91919 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gaaaagcagccttttcccca

SEQ ID NO: 91920 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agataatcgggtcccaggtc

SEQ ID NO: 91921 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atggcatattcagataatcg

SEQ ID NO: 91922 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agaacccatatgactgatgg

SEQ ID NO: 91923 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattcagaacccatatgac

SEQ ID NO: 91924 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgaaattcagaacccatatg

SEQ ID NO: 91925 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccagctctgaaattcagaac

SEQ ID NO: 91926 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctaccagctctgaaattcag

SEQ ID NO: 91927 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acagtcgctcctaccagctc

SEQ ID NO: 91928 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacagtcgctcctaccagct

SEQ ID NO: 91929 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacagtcgctcctaccagc

SEQ ID NO: 91930 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttcacagtcgctcctacc

SEQ ID NO: 91931 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attttcacagtcgctcctac

SEQ ID NO: 91932 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaaatttattttcacagtc

SEQ ID NO: 91933 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaaatttattttcacagt

SEQ ID NO: 91934 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaaatttattttcacag

SEQ ID NO: 91935 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaaaaaatttattttcaca

SEQ ID NO: 91936 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacacaaaatgaatttttaa

SEQ ID NO: 91937 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taggaaagcgcacgcacaca

SEQ ID NO: 91938 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctgtaggaaagcgcacgcac

SEQ ID NO: 91939 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccaggctgctgtaggaaagc

SEQ ID NO: 91940 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctcccaggctgctgtaggaa

SEQ ID NO: 91941 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctcccaggctgctgtagga

SEQ ID NO: 91942 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctcccaggctgctgtag

SEQ ID NO: 91943 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttcctcccaggctgctg

SEQ ID NO: 91944 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cattgttcttcctcccaggc

SEQ ID NO: 91945 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccattgttcttcctcccagg

SEQ ID NO: 91946 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttccattgttcttcctccc

SEQ ID NO: 91947 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccctgtttccattgttct

SEQ ID NO: 91948 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaaagataattcaaccctg

SEQ ID NO: 91949 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaaagataattcaaccct

SEQ ID NO: 91950 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgagaaagataattcaaccc

SEQ ID NO: 91951 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttgagaaagataattcaac

SEQ ID NO: 91952 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctttgagaaagataattca

SEQ ID NO: 91953 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctttgagaaagataattc

SEQ ID NO: 91954 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tttctctttgagaaagataa

SEQ ID NO: 91955 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgtttctctttgagaaaga

SEQ ID NO: 91956 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cctgtttctctttgagaaag

SEQ ID NO: 91957 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gtggaaatttcctgtttctc

SEQ ID NO: 91958 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggtggaaatttcctgtttct

SEQ ID NO: 91959 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttggtggaaatttcctgt

SEQ ID NO: 91960 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cccttggtggaaatttcctg

SEQ ID NO: 91961 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcccttggtggaaatttcc

SEQ ID NO: 91962 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcccttggtggaaatttc

SEQ ID NO: 91963 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttcttcccttggtggaaa

SEQ ID NO: 91964 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttcttcccttggtggaa

SEQ ID NO: 91965 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgatttcttcccttggtgga

SEQ ID NO: 91966 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggccatcctttgatttctt

SEQ ID NO: 91967 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccctatggccatcctttgat

SEQ ID NO: 91968 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaggcaccctgccctatgg

SEQ ID NO: 91969 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gagaggcaccctgccctatg

SEQ ID NO: 91970 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgagaggcaccctgccctat

SEQ ID NO: 91971 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgagaggcaccctgcccta

SEQ ID NO: 91972 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cccttttgagaggcaccctg

SEQ ID NO: 91973 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaagtggtctgcccttttg

SEQ ID NO: 91974 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcctgcaaagtggtctgccc

SEQ ID NO: 91975 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcctgcaaagtggtctgcc

SEQ ID NO: 91976 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgtttatcctgcaaagtgg

SEQ ID NO: 91977 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgatagaaggtgtggaag

SEQ ID NO: 91978 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgatagaaggtgtggaa

SEQ ID NO: 91979 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcatcatttccatgataga

SEQ ID NO: 91980 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagcatcatttccatgata

SEQ ID NO: 91981 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctctaagcatcatttccat

SEQ ID NO: 91982 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cggttatctctaagcatcat

SEQ ID NO: 91983 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccggttatctctaagcatca

SEQ ID NO: 91984 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccggttatctctaagca

SEQ ID NO: 91985 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttccggttatctctaagc

SEQ ID NO: 91986 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atttccttccggttatctct

SEQ ID NO: 91987 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatttccttccggttatctc

SEQ ID NO: 91988 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggatttgatttccttccggt

SEQ ID NO: 91989 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agaagcaaagaaagcagcag

SEQ ID NO: 91990 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caagtcaagaatgtaaggtc

SEQ ID NO: 91991 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
acaagtcaagaatgtaaggt

SEQ ID NO: 91992 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aatagcacatcttacaagtc

SEQ ID NO: 91993 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caatagcacatcttacaagt

SEQ ID NO: 91994 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttcaatagcacatcttaca

SEQ ID NO: 91995 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccttcaatagcacatcttac

SEQ ID NO: 91996 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cttccttcaatagcacatct

SEQ ID NO: 91997 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccttccttcaatagcacatc

SEQ ID NO: 91998 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aagtttccttccttcaatag

SEQ ID NO: 91999 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtcactgaagtttccttcc

SEQ ID NO: 92000 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cacagtctcagtcactgaag

SEQ ID NO: 92001 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgcacagtctcagtcact

SEQ ID NO: 92002 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgcacagtctcagtcac

SEQ ID NO: 92003 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
accttcattgcacagtctca

SEQ ID NO: 92004 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gttcaccttcattgcacagt

SEQ ID NO: 92005 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcacaagtgagctagttcac

SEQ ID NO: 92006 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agaattatcacaagtgagct

SEQ ID NO: 92007 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccaggatatggcactgaga

SEQ ID NO: 92008 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccaggatatggcactgag

SEQ ID NO: 92009 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccaccaatcagggaagagaa

SEQ ID NO: 92010 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tatctaccaccaatcaggga

SEQ ID NO: 92011 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctatatctaccaccaatcag

SEQ ID NO: 92012 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctatatctaccaccaatca

SEQ ID NO: 92013 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcctatatctaccaccaat

SEQ ID NO: 92014 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cttcctatatctaccaccaa

SEQ ID NO: 92015 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcttcctatatctaccacc

SEQ ID NO: 92016 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aactcttcttcctatatcta

SEQ ID NO: 92017 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagttgaactcttcttccta

SEQ ID NO: 92018 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttgcagttgaactcttcttc

SEQ ID NO: 92019 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattgcagttgaactcttc

SEQ ID NO: 92020 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcctattgcagttgaactc

SEQ ID NO: 92021 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ataaaaaagaccattattcc

SEQ ID NO: 92022 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
catctaataaaaaagaccat

SEQ ID NO: 92023 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gcatctaataaaaaagacca

SEQ ID NO: 92024 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cttgcatctaataaaaaaga

SEQ ID NO: 92025 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaataaaagaatgtggcat

SEQ ID NO: 92026 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaataaaagaatgtggca

SEQ ID NO: 92027 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaaaataaaagaatgtggc

SEQ ID NO: 92028 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaaataaaattttaaaaata

SEQ ID NO: 92029 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taaaaataaaattttaaaaa

SEQ ID NO: 92030 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctctaaaaataaaattttaa

SEQ ID NO: 92031 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaattgctctaaaaataaaa

SEQ ID NO: 92032 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgaacctaaaattgctctaa

SEQ ID NO: 92033 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctgtgaacctaaaattgctc

SEQ ID NO: 92034 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gctgtgaacctaaaattgct

SEQ ID NO: 92035 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgctgtgaacctaaaattgc

SEQ ID NO: 92036 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttttgctgtgaacctaaa

SEQ ID NO: 92037 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagttttgctgtgaacctaa

SEQ ID NO: 92038 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccttcagttttgctgtgaac

SEQ ID NO: 92039 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taccctcccttcagttttgc

SEQ ID NO: 92040 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtaccctcccttcagtttt

SEQ ID NO: 92041 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtgggaaatctctgtaccc

SEQ ID NO: 92042 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtgggagtagcggttatgt

SEQ ID NO: 92043 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtgtgggagtagcggttatg

SEQ ID NO: 92044 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgtgtgggagtagcggtta

SEQ ID NO: 92045 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttcttgtgtgggagtagcgg

SEQ ID NO: 92046 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ataatgggggaggctattct

SEQ ID NO: 92047 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtggggaatgttgataatgg

SEQ ID NO: 92048 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtggggaatgttgataat

SEQ ID NO: 92049 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attctggtggggaatgttga

SEQ ID NO: 92050 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattctggtggggaatgttg

SEQ ID NO: 92051 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acaaatgtttcattctggtg

SEQ ID NO: 92052 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacaaatgtttcattctggt

SEQ ID NO: 92053 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacaaatgtttcattctgg

SEQ ID NO: 92054 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttaacaaatgtttcatt

SEQ ID NO: 92055 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaattttaacaaatgttt

SEQ ID NO: 92056 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaagtaagttcattaatttt

SEQ ID NO: 92057 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggagataatgaaacctcaaa

SEQ ID NO: 92058 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gggagataatgaaacctcaa

SEQ ID NO: 92059 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagaccttgggagataatga

SEQ ID NO: 92060 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aatgtgaactacagaccttg

SEQ ID NO: 92061 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accctaaatgtgaactacag

SEQ ID NO: 92062 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
accccatagaatggacaaca

SEQ ID NO: 92063 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctaaccccatagaatggac

SEQ ID NO: 92064 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctaaccccatagaatgga

SEQ ID NO: 92065 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatatttgcctaaccccata

SEQ ID NO: 92066 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taatggtggatacatgtcat

SEQ ID NO: 92067 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taagatactgtaatggtgga

SEQ ID NO: 92068 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgtaagatactgtaatggtg

SEQ ID NO: 92069 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctctgtaagatactgtaatg

SEQ ID NO: 92070 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaattactctgtaagatact

SEQ ID NO: 92071 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggagagaactgaaattact

SEQ ID NO: 92072 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaatgggagatgaataagtg

SEQ ID NO: 92073 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccaggggttgaaatgggaga

SEQ ID NO: 92074 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gccaggggttgaaatgggag

SEQ ID NO: 92075 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taaagacagtaaaatgatca

SEQ ID NO: 92076 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gagaaggcaaaactataaag

SEQ ID NO: 92077 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taggatatcctggagaaggc

SEQ ID NO: 92078 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caactataggatatcctgga

SEQ ID NO: 92079 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgcaactataggatatcct

SEQ ID NO: 92080 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tattattgcaactataggat

SEQ ID NO: 92081 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtattattgcaactatagg

SEQ ID NO: 92082 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tattctgtattattgcaact

SEQ ID NO: 92083 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaagggctatattctgtatt

SEQ ID NO: 92084 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtgaaaggagtcaatctga

SEQ ID NO: 92085 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaagtgaaaggagtcaatc

SEQ ID NO: 92086 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaagcatattgctaagtgaa

SEQ ID NO: 92087 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgaaaagccatggaggaaaa

SEQ ID NO: 92088 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaagctatgaaaagccatg

SEQ ID NO: 92089 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taaagaaatgagctatcaag

SEQ ID NO: 92090 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agcactgtaaagaaatgagc

SEQ ID NO: 92091 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcagcactgtaaagaaatg

SEQ ID NO: 92092 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tggtaccaccagtcaatgga

SEQ ID NO: 92093 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtaggtgaatgaataaact

SEQ ID NO: 92094 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtaggtgaatgaataaac

SEQ ID NO: 92095 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaagcaaacaagatgtcctt

SEQ ID NO: 92096 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ggaagcaaacaagatgtcct

SEQ ID NO: 92097 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aaacttggaagcaaacaaga

SEQ ID NO: 92098 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaaacttggaagcaaaca

SEQ ID NO: 92099 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cgcataattgctaaaacttg

SEQ ID NO: 92100 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
acgcataattgctaaaactt

SEQ ID NO: 92101 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tacgcataattgctaaaact

SEQ ID NO: 92102 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagaggctttacgcataatt

SEQ ID NO: 92103 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagaggctttacgcataat

SEQ ID NO: 92104 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaaagatgtttatagaggc

SEQ ID NO: 92105 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacaaagatgtttatagagg

SEQ ID NO: 92106 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaacatgtccacacagtaa

SEQ ID NO: 92107 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaaaacatgtccacacagta

SEQ ID NO: 92108 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acccaaaggacttgaaaaca

SEQ ID NO: 92109 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atgttcacccaaaggacttg

SEQ ID NO: 92110 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gatgttcacccaaaggactt

SEQ ID NO: 92111 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cttgatgttcacccaaagga

SEQ ID NO: 92112 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgctccttgatgttcaccca

SEQ ID NO: 92113 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
accatatgatccagcaattg

SEQ ID NO: 92114 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaccatatgatccagcaat

SEQ ID NO: 92115 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aacatactctcaccatatga

SEQ ID NO: 92116 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaactaaacatactctcac

SEQ ID NO: 92117 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaaactaaacatactctca

SEQ ID NO: 92118 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaaaactaaacatactctc

SEQ ID NO: 92119 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttaaaaactaaacatactc

SEQ ID NO: 92120 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttaaaaactaaacatact

SEQ ID NO: 92121 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggacagtgtagcagtttct

SEQ ID NO: 92122 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggacagtgtagcagtttc

SEQ ID NO: 92123 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgaggacagtgtagcagttt

SEQ ID NO: 92124 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cagccactttgaggacagtg

SEQ ID NO: 92125 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtgggaatgcaaaatgctcc

SEQ ID NO: 92126 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctggtgggaatgcaaaatgc

SEQ ID NO: 92127 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atgtattgctggtgggaatg

SEQ ID NO: 92128 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcatgtattgctggtgggaa

SEQ ID NO: 92129 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaaggatgtgaggcaaca

SEQ ID NO: 92130 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggccaaggatgtgaggcaa

SEQ ID NO: 92131 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
atgatatcaagttctggcca

SEQ ID NO: 92132 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaataaccaaaatccagaac

SEQ ID NO: 92133 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tggtatcaacaatgggcatg

SEQ ID NO: 92134 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atggtatcaacaatgggcat

SEQ ID NO: 92135 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaataagcatataaaaagg

SEQ ID NO: 92136 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acagaccaaagaagatgcac

SEQ ID NO: 92137 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aacagaccaaagaagatgca

SEQ ID NO: 92138 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacaacaagaaaagaaataa

SEQ ID NO: 92139 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaactcaacaacaagaaaag

SEQ ID NO: 92140 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaaactcaacaacaagaaaa

SEQ ID NO: 92141 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
accaaaatatacaaataaag

SEQ ID NO: 92142 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttaaccaaaatatacaaata

SEQ ID NO: 92143 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acaaatgactgttaaccaaa

SEQ ID NO: 92144 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
caaaagacacatctgacaaa

SEQ ID NO: 92145 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcaaaagacacatctgacaa

SEQ ID NO: 92146 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gataaatatttgcaaaagac

SEQ ID NO: 92147 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caaaaacggacaacaagcca

SEQ ID NO: 92148 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgcaaaaacggacaacaagc

SEQ ID NO: 92149 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctctgcaaaaacggacaaca

SEQ ID NO: 92150 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgctctgcaaaaacggacaa

SEQ ID NO: 92151 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgctctgcaaaaacggaca

SEQ ID NO: 92152 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaaacttctgctctgcaaaa

SEQ ID NO: 92153 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattaaaaacttctgctct

SEQ ID NO: 92154 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cattaaaattaaaaacttct

SEQ ID NO: 92155 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
aggtgaactgcattaaaatt

SEQ ID NO: 92156 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ctaaggtgaactgcattaaa

SEQ ID NO: 92157 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taagagacataattgctaag

SEQ ID NO: 92158 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatataacagcaaaggcata

SEQ ID NO: 92159 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagatataacagcaaaggca

SEQ ID NO: 92160 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttctagatataacagcaaag

SEQ ID NO: 92161 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acatatgtgttattctagat

SEQ ID NO: 92162 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agaatgtatctaacatatgt

SEQ ID NO: 92163 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taagaatgtatctaacatat

SEQ ID NO: 92164 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cactctaagaatgtatctaa

SEQ ID NO: 92165 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattccactctaagaatg

SEQ ID NO: 92166 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatataatgtataatgcatt

SEQ ID NO: 92167 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatatataggttatatata

SEQ ID NO: 92168 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taacataatatagtaatata

SEQ ID NO: 92169 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tacataacatatattataac

SEQ ID NO: 92170 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatacaacatatgtattata

SEQ ID NO: 92171 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tatattatatacaacatatg

SEQ ID NO: 92172 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagtggaatatataatatgt

SEQ ID NO: 92173 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aaagtggaatatataatatg

SEQ ID NO: 92174 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atggatgcttaaagtggaat

SEQ ID NO: 92175 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaatggatgcttaaagtgg

SEQ ID NO: 92176 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gttaatggatgcttaaagtg

SEQ ID NO: 92177 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttgttaatggatgcttaaag

SEQ ID NO: 92178 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
agaatagtaagttcttgtta

SEQ ID NO: 92179 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gatatattgagaatagtaag

SEQ ID NO: 92180 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
acaagaacctagatatattg

SEQ ID NO: 92181 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
taacaagaacctagatatat

SEQ ID NO: 92182 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagatctctaacaagaacct

SEQ ID NO: 92183 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagatctctaacaagaacc

SEQ ID NO: 92184 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtttgaagatctctaacaa

SEQ ID NO: 92185 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atgtttgaagatctctaaca

SEQ ID NO: 92186 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatgtttgaagatctctaac

SEQ ID NO: 92187 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
caggattttatgtttgaaga

SEQ ID NO: 92188 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccaggattttatgtttgaag

SEQ ID NO: 92189 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tccaggattttatgtttgaa

SEQ ID NO: 92190 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcattttccaggattttatg

SEQ ID NO: 92191 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atcattttccaggattttat

SEQ ID NO: 92192 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatcattttccaggatttta

SEQ ID NO: 92193 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttttatcattttccaggat

SEQ ID NO: 92194 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggttttatcattttccagga

SEQ ID NO: 92195 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tggttttatcattttccagg

SEQ ID NO: 92196 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttggttttatcattttccag

SEQ ID NO: 92197 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttggttttatcattttc

SEQ ID NO: 92198 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttggttttatcatttt

SEQ ID NO: 92199 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tatttttggttttatcattt

SEQ ID NO: 92200 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtcagaccaagaggatttt

SEQ ID NO: 92201 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
caagggatccctcagtcaga

SEQ ID NO: 92202 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
acagggaaaatcctgcaagg

SEQ ID NO: 92203 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgagctcacagggaaaatcc

SEQ ID NO: 92204 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctatgagctcacagggaaa

SEQ ID NO: 92205 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcctatgagctcacagggaa

SEQ ID NO: 92206 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgcctatgagctcacaggga

SEQ ID NO: 92207 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgctttgcctatgagctca

SEQ ID NO: 92208 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ggaaaataatgaataatata

SEQ ID NO: 92209 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaacatgaaagaaaattggg

SEQ ID NO: 92210 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggaatggcacataaaagaaa

SEQ ID NO: 92211 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagactaggaatggcacata

SEQ ID NO: 92212 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgtagactaggaatggcaca

SEQ ID NO: 92213 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atgttctgtagactaggaat

SEQ ID NO: 92214 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ccaaaagagcaagaaaaaca

SEQ ID NO: 92215 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggctgccaaaagagcaaga

SEQ ID NO: 92216 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagggctgccaaaagagcaa

SEQ ID NO: 92217 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctagggctgccaaaagagca

SEQ ID NO: 92218 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaccaagataaaatttctag

SEQ ID NO: 92219 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaaccaagataaaatttcta

SEQ ID NO: 92220 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ggtttaaaccaagataaaat

SEQ ID NO: 92221 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgggtttaaaccaagataaa

SEQ ID NO: 92222 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctgggtttaaaccaagataa

SEQ ID NO: 92223 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctgggtttaaaccaagata

SEQ ID NO: 92224 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctgggtttaaaccaagat

SEQ ID NO: 92225 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttctgggtttaaaccaaga

SEQ ID NO: 92226 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gaaagatactttttctgggt

SEQ ID NO: 92227 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ggaaagatactttttctggg

SEQ ID NO: 92228 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ataagaaatttggaaagata

SEQ ID NO: 92229 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aataagaaatttggaaagat

SEQ ID NO: 92230 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgcagtgtagtatttaataa

SEQ ID NO: 92231 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aaggctgtgcagtgtagtat

SEQ ID NO: 92232 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tcaaggctgtgcagtgtagt

SEQ ID NO: 92233 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atgaactctcaaggctgtgc

SEQ ID NO: 92234 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aatgaactctcaaggctgtg

SEQ ID NO: 92235 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gtgtttaatgaactctcaag

SEQ ID NO: 92236 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agtgtttaatgaactctcaa

SEQ ID NO: 92237 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcatttagtgtttaatgaac

SEQ ID NO: 92238 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
acgctgtcatttagtgttta

SEQ ID NO: 92239 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catctgacgctgtcatttag

SEQ ID NO: 92240 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tgtctacatctgacgctgtc

SEQ ID NO: 92241 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atgtctacatctgacgctgt

SEQ ID NO: 92242 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttatgtctacatctgacgc

SEQ ID NO: 92243 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aacgtaccatctacttatgt

SEQ ID NO: 92244 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaacgtaccatctacttatg

SEQ ID NO: 92245 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taaacgtaccatctacttat

SEQ ID NO: 92246 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aattttaaacgtaccatcta

SEQ ID NO: 92247 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aaattttaaacgtaccatct

SEQ ID NO: 92248 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
taaattttaaacgtaccatc

SEQ ID NO: 92249 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ccctttaaattttaaacgta

SEQ ID NO: 92250 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aagcctaccctttaaatttt

SEQ ID NO: 92251 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcaagcctaccctttaaa

SEQ ID NO: 92252 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aattcaagcctaccctttaa

SEQ ID NO: 92253 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ccttaattcaagcctaccct

SEQ ID NO: 92254 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gttcccttaattcaagccta

SEQ ID NO: 92255 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctggttcccttaattcaag

SEQ ID NO: 92256 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtctggttcccttaattcaa

SEQ ID NO: 92257 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtctggttcccttaattca

SEQ ID NO: 92258 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aaccagacaggctttgtctg

SEQ ID NO: 92259 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
caaccagacaggctttgtct

SEQ ID NO: 92260 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcaaccagacaggctttgtc

SEQ ID NO: 92261 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcaaccagacaggctttgt

SEQ ID NO: 92262 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttcaaccagacaggctttg

SEQ ID NO: 92263 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gctttttcaaccagacaggc

SEQ ID NO: 92264 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggctttttcaaccagaca

SEQ ID NO: 92265 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
gttattggctttttcaacca

SEQ ID NO: 92266 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttggttattggctttttcaa

SEQ ID NO: 92267 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attggttattggctttttca

SEQ ID NO: 92268 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaacttattggttattggc

SEQ ID NO: 92269 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taaatatgattaggaactta

SEQ ID NO: 92270 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cggaaggtcagttgtaaata

SEQ ID NO: 92271 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agttacggaaggtcagttgt

SEQ ID NO: 92272 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tctaagttacggaaggtcag

SEQ ID NO: 92273 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatctaagttacggaaggtc

SEQ ID NO: 92274 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatctaagttacggaaggt

SEQ ID NO: 92275 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatctaagttacggaagg

SEQ ID NO: 92276 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctatctaagttacggaag

SEQ ID NO: 92277 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cacatttttctatctaagtt

SEQ ID NO: 92278 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccacatttttctatctaagt

SEQ ID NO: 92279 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
aacatttccacatttttcta

SEQ ID NO: 92280 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catgactcaacatttccaca

SEQ ID NO: 92281 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatgactcaacatttccac

SEQ ID NO: 92282 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atttccatgactcaacattt

SEQ ID NO: 92283 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaatttccatgactcaac

SEQ ID NO: 92284 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatgatgttagttaatttcc

SEQ ID NO: 92285 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtatggattgtatgatgtta

SEQ ID NO: 92286 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggtatggattgtatgatgt

SEQ ID NO: 92287 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttctggtatggattgtatga

SEQ ID NO: 92288 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctattctggtatggattgta

SEQ ID NO: 92289 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcctattctggtatggatt

SEQ ID NO: 92290 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attcctattctggtatggat

SEQ ID NO: 92291 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttattcctattctggtatgg

SEQ ID NO: 92292 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agggaaataaaattcttatt

SEQ ID NO: 92293 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actaagggaaataaaattct

SEQ ID NO: 92294 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcactaagggaaataaaatt

SEQ ID NO: 92295 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcactaagggaaataaaat

SEQ ID NO: 92296 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttctcactaagggaaataa

SEQ ID NO: 92297 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttctcactaagggaaata

SEQ ID NO: 92298 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tggaaaatacagaagtgtgg

SEQ ID NO: 92299 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagtggcaattgtggaaaat

SEQ ID NO: 92300 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aaaattgcagtggcaattgt

SEQ ID NO: 92301 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaaaattgcagtggcaattg

SEQ ID NO: 92302 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaaaattgcagtggcaatt

SEQ ID NO: 92303 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagttttgaaaattgcagtg

SEQ ID NO: 92304 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacagttttgaaaattgcag

SEQ ID NO: 92305 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctacagttttgaaaattgca

SEQ ID NO: 92306 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
cagaaacttctacagttttg

SEQ ID NO: 92307 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ccagaaacttctacagtttt

SEQ ID NO: 92308 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttccagaaacttctacagtt

SEQ ID NO: 92309 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttcttccagaaacttctaca

SEQ ID NO: 92310 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttcttccagaaacttctac

SEQ ID NO: 92311 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttcttccagaaacttcta

SEQ ID NO: 92312 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttcttccagaaacttct

SEQ ID NO: 92313 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttgttcttccagaaacttc

SEQ ID NO: 92314 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttttgttcttccagaaac

SEQ ID NO: 92315 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctattttttgttcttccag

SEQ ID NO: 92316 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtctattttttgttcttc

SEQ ID NO: 92317 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atattactgtctattttttg

SEQ ID NO: 92318 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aatattactgtctatttttt

SEQ ID NO: 92319 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccttaatattactgtctatt

SEQ ID NO: 92320 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttgccttaatattactgtct

SEQ ID NO: 92321 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attgccttaatattactgtc

SEQ ID NO: 92322 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tattgccttaatattactgt

SEQ ID NO: 92323 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attttattgccttaatatta

SEQ ID NO: 92324 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tattaattttattgccttaa

SEQ ID NO: 92325 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtattgtattaattttatt

SEQ ID NO: 92326 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cagtattgtattaattttat

SEQ ID NO: 92327 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tcagtattgtattaatttta

SEQ ID NO: 92328 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttcagtattgtattaattt

SEQ ID NO: 92329 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gagaaaaacaaactctttca

SEQ ID NO: 92330 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attagagaaaaacaaactct

SEQ ID NO: 92331 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aattagagaaaaacaaactc

SEQ ID NO: 92332 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttaattagagaaaaacaaa

SEQ ID NO: 92333 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atcctatttaattagagaaa

SEQ ID NO: 92334 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
taatcctatttaattagaga

SEQ ID NO: 92335 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctaatcctatttaattagag

SEQ ID NO: 92336 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctaatcctatttaattaga

SEQ ID NO: 92337 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttctaatcctatttaattag

SEQ ID NO: 92338 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaggtaaaagtatttttct

SEQ ID NO: 92339 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ccgtgcagccaatattagaa

SEQ ID NO: 92340 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taatattgccgtgcagccaa

SEQ ID NO: 92341 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtaatattgccgtgcagcca

SEQ ID NO: 92342 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtaatattgccgtgcagcc

SEQ ID NO: 92343 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctttgtaatattgccgtgca

SEQ ID NO: 92344 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actttgtaatattgccgtgc

SEQ ID NO: 92345 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttactttgtaatattgccgt

SEQ ID NO: 92346 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttactttgtaatattgccg

SEQ ID NO: 92347 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttactttgtaatattgcc

SEQ ID NO: 92348 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttactttgtaatattgc

SEQ ID NO: 92349 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tttcttactttgtaatattg

SEQ ID NO: 92350 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttttcttactttgtaata

SEQ ID NO: 92351 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acaacagaataattgttttt

SEQ ID NO: 92352 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacaacagaataattgtttt

SEQ ID NO: 92353 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacaacagaataattgttt

SEQ ID NO: 92354 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ttttcacaacagaataattg

SEQ ID NO: 92355 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tattttcacaacagaataat

SEQ ID NO: 92356 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctattttcacaacagaataa

SEQ ID NO: 92357 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttctattttcacaacagaat

SEQ ID NO: 92358 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttcttctattttcacaacag

SEQ ID NO: 92359 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
attcttctattttcacaaca

SEQ ID NO: 92360 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tattcttctattttcacaac

SEQ ID NO: 92361 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
taactttattcttctatttt

SEQ ID NO: 92362 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtaactttattcttctattt

SEQ ID NO: 92363 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtatacacaaaacttgtaa

SEQ ID NO: 92364 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gctatgtatacacaaaactt

SEQ ID NO: 92365 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agctatgtatacacaaaact

SEQ ID NO: 92366 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagctatgtatacacaaaac

SEQ ID NO: 92367 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagctatgtatacacaaaa

SEQ ID NO: 92368 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagctatgtatacacaaa

SEQ ID NO: 92369 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctttttagctatgtatacac

SEQ ID NO: 92370 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aatcctactttttagctatg

SEQ ID NO: 92371 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaatcctactttttagctat

SEQ ID NO: 92372 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaatcctactttttagcta

SEQ ID NO: 92373 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttgaatcctactttttagct

SEQ ID NO: 92374 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttttgaatcctacttttta

SEQ ID NO: 92375 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacttttgaatcctactttt

SEQ ID NO: 92376 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aagttctacttttgaatcct

SEQ ID NO: 92377 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaagttctacttttgaatcc

SEQ ID NO: 92378 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatttgaagttctactttt

SEQ ID NO: 92379 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttataatttgaagttctac

SEQ ID NO: 92380 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agttataatttgaagttcta

SEQ ID NO: 92381 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tagttataatttgaagttct

SEQ ID NO: 92382 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttagttataatttgaagttc

SEQ ID NO: 92383 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tttagttataatttgaagtt

SEQ ID NO: 92384 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttttagttataatttgaag

SEQ ID NO: 92385 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttttagttataatttgaa

SEQ ID NO: 92386 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tttctttttagttataattt

SEQ ID NO: 92387 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatttctttttagttataat

SEQ ID NO: 92388 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tatattctatttctttttag

SEQ ID NO: 92389 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attgtatattctatttcttt

SEQ ID NO: 92390 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cattgtatattctatttctt

SEQ ID NO: 92391 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ataatcttcattgtatattc

SEQ ID NO: 92392 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtctgataatcttcattgt

SEQ ID NO: 92393 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
caatctatgtctgataatct

SEQ ID NO: 92394 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
atcactccaatctatgtctg

SEQ ID NO: 92395 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccatctcatcactccaatc

SEQ ID NO: 92396 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gcccatctcatcactccaat

SEQ ID NO: 92397 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agcatcatttgcccatctca

SEQ ID NO: 92398 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
attaagcatcatttgcccat

SEQ ID NO: 92399 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cattaagcatcatttgccca

SEQ ID NO: 92400 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tttcattaagcatcatttgc

SEQ ID NO: 92401 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agttgtttcattaagcatca

SEQ ID NO: 92402 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagttgtttcattaagcatc

SEQ ID NO: 92403 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcagttgtttcattaagca

SEQ ID NO: 92404 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcagttgtttcattaagc

SEQ ID NO: 92405 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcagttgtttcattaag

SEQ ID NO: 92406 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcttcagttgtttcattaa

SEQ ID NO: 92407 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttttcttcagttgtttcatt

SEQ ID NO: 92408 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggaaacctcttttcttcagt

SEQ ID NO: 92409 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggaaacctcttttcttcag

SEQ ID NO: 92410 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agatgccaatacatttagga

SEQ ID NO: 92411 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacgagcaaacactcagatg

SEQ ID NO: 92412 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gccaaaaaaatccagaccac

SEQ ID NO: 92413 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggccaaaaaaatccagacc

SEQ ID NO: 92414 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggccaaaaaaatccagac

SEQ ID NO: 92415 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggccaaaaaaatccaga

SEQ ID NO: 92416 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acatcagttttctggccaaa

SEQ ID NO: 92417 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cacatcagttttctggccaa

SEQ ID NO: 92418 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcacatcagttttctggcc

SEQ ID NO: 92419 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cttcacatcagttttctggc

SEQ ID NO: 92420 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcttcacatcagttttctgg

SEQ ID NO: 92421 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttcttcacatcagttttctg

SEQ ID NO: 92422 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tttttcttcacatcagtttt

SEQ ID NO: 92423 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atttttcttcacatcagttt

SEQ ID NO: 92424 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
catgcaagacaaaacattta

SEQ ID NO: 92425 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ctacatgcaagacaaaacat

SEQ ID NO: 92426 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agcatctactacatgcaaga

SEQ ID NO: 92427 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctaagcatctactacatgca

SEQ ID NO: 92428 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
actaagcatctactacatgc

SEQ ID NO: 92429 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
atatacttactaagcatcta

SEQ ID NO: 92430 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
aggaataagtaatcaattaa

SEQ ID NO: 92431 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
caggaataagtaatcaatta

SEQ ID NO: 92432 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ttcaggaataagtaatcaat

SEQ ID NO: 92433 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaaaattcttcaggaata

SEQ ID NO: 92434 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgacactggggaaaattctt

SEQ ID NO: 92435 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtaagggacccatcagtg

SEQ ID NO: 92436 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttagggtaagggacccatca

SEQ ID NO: 92437 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tcagcaaaaccattgttagg

SEQ ID NO: 92438 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cacagaaagcacattatcag

SEQ ID NO: 92439 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
atcaaaaataactccacaga

SEQ ID NO: 92440 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gatcaaaaataactccacag

SEQ ID NO: 92441 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgatcaaaaataactccaca

SEQ ID NO: 92442 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
caagggaatgtcgataacaa

SEQ ID NO: 92443 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacaagggaatgtcgataac

SEQ ID NO: 92444 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctacaagggaatgtcgataa

SEQ ID NO: 92445 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
atggaagacttctacaaggg

SEQ ID NO: 92446 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tctaatggaagacttctaca

SEQ ID NO: 92447 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atctaatggaagacttctac

SEQ ID NO: 92448 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tccccttatctaatggaaga

SEQ ID NO: 92449 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtccccttatctaatggaag

SEQ ID NO: 92450 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgtccccttatctaatggaa

SEQ ID NO: 92451 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atatattttgtccccttatc

SEQ ID NO: 92452 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
catatattttgtccccttat

SEQ ID NO: 92453 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgtttcatatattttgtcc

SEQ ID NO: 92454 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
aaaactagtgtttcatatat

SEQ ID NO: 92455 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cccaatgactgaaaactagt

SEQ ID NO: 92456 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagataatgttgcccaatga

SEQ ID NO: 92457 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
atagataatgttgcccaatg

SEQ ID NO: 92458 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcttatagataatgttgccc

SEQ ID NO: 92459 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gggatcactgtcttatagat

SEQ ID NO: 92460 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tagggatcactgtcttatag

SEQ ID NO: 92461 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctagggatcactgtcttat

SEQ ID NO: 92462 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctctagggatcactgtctta

SEQ ID NO: 92463 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttctctagggatcactgtct

SEQ ID NO: 92464 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcttctctagggatcactgt

SEQ ID NO: 92465 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcttctctagggatcactg

SEQ ID NO: 92466 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctcttctctagggatcact

SEQ ID NO: 92467 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctcttctctagggatca

SEQ ID NO: 92468 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctttctcttctctagggatc

SEQ ID NO: 92469 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctttctcttctctagggat

SEQ ID NO: 92470 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
actttctttctcttctctag

SEQ ID NO: 92471 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtagtatgcagagacaatc

SEQ ID NO: 92472 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtagtatgcagagacaat

SEQ ID NO: 92473 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgtgtagtatgcagagacaa

SEQ ID NO: 92474 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gaaactttgtgtagtatgca

SEQ ID NO: 92475 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
agaaactttgtgtagtatgc

SEQ ID NO: 92476 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tggtttagaaactttgtgta

SEQ ID NO: 92477 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
agctgtggtttagaaacttt

SEQ ID NO: 92478 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
ctgagctgtggtttagaaac

SEQ ID NO: 92479 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cctgagctgtggtttagaaa

SEQ ID NO: 92480 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
catcttcctgagctgtggtt

SEQ ID NO: 92481 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ccatcttcctgagctgtggt

SEQ ID NO: 92482 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
atgtttccatcttcctgagc

SEQ ID NO: 92483 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
catgtttccatcttcctgag

SEQ ID NO: 92484 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttcatgtttccatcttcctg

SEQ ID NO: 92485 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gctcttcatgtttccatctt

SEQ ID NO: 92486 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tggctcttcatgtttccatc

SEQ ID NO: 92487 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctggctcttcatgtttccat

SEQ ID NO: 92488 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctggctcttcatgtttcca

SEQ ID NO: 92489 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ttttctggctcttcatgttt

SEQ ID NO: 92490 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
attttctggctcttcatgtt

SEQ ID NO: 92491 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ttattttctggctcttcatg

SEQ ID NO: 92492 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tcaaactcttattttctggc

SEQ ID NO: 92493 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agcctatcaaactcttattt

SEQ ID NO: 92494 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cctcagcctatcaaactctt

SEQ ID NO: 92495 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gctccctcagcctatcaaac

SEQ ID NO: 92496 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tagctccctcagcctatcaa

SEQ ID NO: 92497 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcccaaataaacaaattcta

SEQ ID NO: 92498 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtgtcctgtcccaaataaa

SEQ ID NO: 92499 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aggtgtcctgtcccaaataa

SEQ ID NO: 92500 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tcttaggtgtcctgtcccaa

SEQ ID NO: 92501 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gtcttaggtgtcctgtccca

SEQ ID NO: 92502 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ccttgtcttaggtgtcctgt

SEQ ID NO: 92503 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agctcccttgtcttaggtgt

SEQ ID NO: 92504 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ttcagctcccttgtcttagg

SEQ ID NO: 92505 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tgttcagctcccttgtctta

SEQ ID NO: 92506 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tctgttcagctcccttgtct

SEQ ID NO: 92507 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gtatactctctgttcagctc

SEQ ID NO: 92508 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggtatactctctgttcagc

SEQ ID NO: 92509 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cagatctctggtatactctc

SEQ ID NO: 92510 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tacagatctctggtatactc

SEQ ID NO: 92511 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctacagatctctggtatact

SEQ ID NO: 92512 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctacagatctctggtatac

SEQ ID NO: 92513 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tttctacagatctctggtat

SEQ ID NO: 92514 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtctctttctacagatct

SEQ ID NO: 92515 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
gaggtctctttctacagatc

SEQ ID NO: 92516 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tcaagcaaaaacttgaggtc

SEQ ID NO: 92517 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cagaatgctgtcaagcaaaa

SEQ ID NO: 92518 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
acacaattgcagaatgctgt

SEQ ID NO: 92519 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cacacaattgcagaatgctg

SEQ ID NO: 92520 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcacacaattgcagaatgct

SEQ ID NO: 92521 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttttcacacaattgcagaat

SEQ ID NO: 92522 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gttttcacacaattgcagaa

SEQ ID NO: 92523 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgttttcacacaattgcaga

SEQ ID NO: 92524 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttgttttcacacaattgcag

SEQ ID NO: 92525 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gggtatttttgttttcacac

SEQ ID NO: 92526 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
agggtatttttgttttcaca

SEQ ID NO: 92527 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gcttagggtatttttgtttt

SEQ ID NO: 92528 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tggcttagggtatttttgtt

SEQ ID NO: 92529 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tctggcttagggtatttttg

SEQ ID NO: 92530 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctctggcttagggtattttt

SEQ ID NO: 92531 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tctctggcttagggtatttt

SEQ ID NO: 92532 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tttctctggcttagggtatt

SEQ ID NO: 92533 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tagttctttctctggcttag

SEQ ID NO: 92534 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggcaatgcatgactgtagtt

SEQ ID NO: 92535 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
ttaggcaatgcatgactgta

SEQ ID NO: 92536 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
cattgttaggcaatgcatga

SEQ ID NO: 92537 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ggtacatatctccattgtta

SEQ ID NO: 92538 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tcggtacatatctccattgt

SEQ ID NO: 92539 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctcggtacatatctccattg

SEQ ID NO: 92540 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gtgacacatttctcggtaca

SEQ ID NO: 92541 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
cctagtgacacatttctcgg

SEQ ID NO: 92542 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aaattgcctagtgacacatt

SEQ ID NO: 92543 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgatgttaaaattgcctagt

SEQ ID NO: 92544 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
tatgatgttaaaattgccta

SEQ ID NO: 92545 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tctctatgatgttaaaattg

SEQ ID NO: 92546 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tgtaagtactgtctctatga

SEQ ID NO: 92547 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gtgtaagtactgtctctatg

SEQ ID NO: 92548 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
ggtttgtgtaagtactgtct

SEQ ID NO: 92549 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taccatctaggtttgtgtaa

SEQ ID NO: 92550 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agtatgtagtagactatacc

SEQ ID NO: 92551 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
taccataaagactaagtatg

SEQ ID NO: 92552 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
gaagcaataggctataccat

SEQ ID NO: 92553 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
tagcctagaagcaataggct

SEQ ID NO: 92554 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
atagcctagaagcaataggc

SEQ ID NO: 92555 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tacaggtttatagcctagaa

SEQ ID NO: 92556 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
agtacagtaacatgttgtac

SEQ ID NO: 92557 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
tctcagtacagtaacatgtt

SEQ ID NO: 92558 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
caattgtctcagtacagtaa

SEQ ID NO: 92559 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttacaattgtctcagtac

SEQ ID NO: 92560 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gacacaaaaataccactgtg

SEQ ID NO: 92561 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ggtatgattagacacaaaaa

SEQ ID NO: 92562 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aggtatgattagacacaaaa

SEQ ID NO: 92563 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tgtttaggtatgattagaca

SEQ ID NO: 92564 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tatgtttaggtatgattaga

SEQ ID NO: 92565 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ctatgtttaggtatgattag

SEQ ID NO: 92566 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tctatgtttaggtatgatta

SEQ ID NO: 92567 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttctatgtttaggtatgatt

SEQ ID NO: 92568 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
taacttttctatgtttaggt

SEQ ID NO: 92569 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctgtaacttttctatgttta

SEQ ID NO: 92570 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
actgtaacttttctatgttt

SEQ ID NO: 92571 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tactgtaacttttctatgtt

SEQ ID NO: 92572 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttactgtaacttttctatgt

SEQ ID NO: 92573 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tatttttactgtaacttttc

SEQ ID NO: 92574 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
taatactgtatttttactgt

SEQ ID NO: 92575 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
catatatgatggtggtccca

SEQ ID NO: 92576 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agtcaaggacagactgcata

SEQ ID NO: 92577 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
cagtcaaggacagactgcat

SEQ ID NO: 92578 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
cagtcatgtcagtcatgtgc

SEQ ID NO: 92579 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
agattacagtcatgtcagtc

SEQ ID NO: 92580 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
aagattacagtcatgtcagt

SEQ ID NO: 92581 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cttaagattacagtcatgtc

SEQ ID NO: 92582 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctacttaagattacagtcat

SEQ ID NO: 92583 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
acctgctacttaagattaca

SEQ ID NO: 92584 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
aacctgctacttaagattac

SEQ ID NO: 92585 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
taacctgctacttaagatta

SEQ ID NO: 92586 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
ttaacctgctacttaagatt

SEQ ID NO: 92587 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgtgaggtccaagaattttt

SEQ ID NO: 92588 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
tccctgtgtgaggtccaaga

SEQ ID NO: 92589 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
ctatccctgtgtgaggtcca

SEQ ID NO: 92590 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
gggaggataaaatattacta

SEQ ID NO: 92591 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
actggggaggataaaatatt

SEQ ID NO: 92592 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gactggggaggataaaatat

SEQ ID NO: 92593 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
tgactggggaggataaaata

SEQ ID NO: 92594 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
actttgactggggaggataa

SEQ ID NO: 92595 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
cactttgactggggaggata

SEQ ID NO: 92596 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tcactttgactggggaggat

SEQ ID NO: 92597 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ttcactttgactggggagga

SEQ ID NO: 92598 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTG
aggtcttttcactttgactg

SEQ ID NO: 92599 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
gaggtcttttcactttgact

SEQ ID NO: 92600 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTT
tgaggtcttttcactttgac

SEQ ID NO: 92601 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
tgttttgaggtcttttcact

SEQ ID NO: 92602 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTC
ctgtgttttgaggtcttttc

SEQ ID NO: 92603 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
cccaatatctcctgtgtttt

SEQ ID NO: 92604 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
cagagtctacccaatatctc

SEQ ID NO: 92605 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
tgcagagtctacccaatatc

SEQ ID NO: 92606 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTT
ctgcagagtctacccaatat

SEQ ID NO: 92607 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTA
agataagacccttctgcaga

SEQ ID NO: 92608 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: CTG
ctaagataagacccttctgc

SEQ ID NO: 92609 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTC
agccccactgctaagataag

SEQ ID NO: 92610 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
attcagccccactgctaaga

SEQ ID NO: 92611 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
aagttaattcagccccactg

SEQ ID NO: 92612 - DNA, 20 bp, synthetic construct
  source 1..20: mol_type = other DNA; note = Description of Artificial Sequence: Synthetic oligonucleotide; note = Target: SCN9A; (-) strand; PAM type: YTN; PAM sequence: TTA
gttaaagttaattcagcccc

SEQ ID NO: 92613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atagctaaggtaatgtcggt

SEQ ID NO: 92614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aggtaatgtcggttatccat

SEQ ID NO: 92615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccatgattcatacttttat

SEQ ID NO: 92616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atacttttatagacattgtc

SEQ ID NO: 92617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatagacattgtcagagat

SEQ ID NO: 92618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagacattgtcagagatc

SEQ ID NO: 92619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagacattgtcagagatca

SEQ ID NO: 92620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagacattgtcagagatcag

SEQ ID NO: 92621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcagagatcagtcgttgtca

SEQ ID NO: 92622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaactggggaagattttgt

SEQ ID NO: 92623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggaagattttgtccccctg

SEQ ID NO: 92624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtccccctgagaacattta

SEQ ID NO: 92625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtccccctgagaacatttag

SEQ ID NO: 92626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccccctgagaacatttagc

SEQ ID NO: 92627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaacatttagcaaagatgg

SEQ ID NO: 92628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcaaagatggggacatttt

SEQ ID NO: 92629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcaaagatggggacattttt

SEQ ID NO: 92630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatttgtcataactgtgga

SEQ ID NO: 92631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttgtcataactgtggaa

SEQ ID NO: 92632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgtcataactgtggaat

SEQ ID NO: 92633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgtcataactgtggaatt

SEQ ID NO: 92634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcataactgtggaattagg

SEQ ID NO: 92635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcataactgtggaattagga

SEQ ID NO: 92636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggaattaggaatgtttatt

SEQ ID NO: 92637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaatgtttattgatatcta

SEQ ID NO: 92638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgatatctagaggttaga

SEQ ID NO: 92639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgatatctagaggttagag

SEQ ID NO: 92640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatctagaggttagagacc

SEQ ID NO: 92641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaggttagagaccagtgatc

SEQ ID NO: 92642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaccagtgatcgtgctaa

SEQ ID NO: 92643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacatcccaccatgcacagg

SEQ ID NO: 92644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaacaaagaattatccagc

SEQ ID NO: 92645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccagctcaaatatcaagat

SEQ ID NO: 92646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaatatcaagattgccaata

SEQ ID NO: 92647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaatattgagaaactcagg

SEQ ID NO: 92648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaactcaggccttagaga

SEQ ID NO: 92649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggccttagagaaataaatg

SEQ ID NO: 92650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agagaaataaatgtctgatt

SEQ ID NO: 92651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaaataaatgtctgattt

SEQ ID NO: 92652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attttaatgtagaatgtata

SEQ ID NO: 92653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatgtagaatgtatatgaa

SEQ ID NO: 92654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgtagaatgtatatgaaa

SEQ ID NO: 92655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtagaatgtatatgaaag

SEQ ID NO: 92656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatttttcagtctttattt

SEQ ID NO: 92657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttttcagtctttatttc

SEQ ID NO: 92658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttcagtctttatttcc

SEQ ID NO: 92659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcagtctttatttcctact

SEQ ID NO: 92660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagtctttatttcctactt

SEQ ID NO: 92661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtctttatttcctacttg

SEQ ID NO: 92662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtctttatttcctacttga

SEQ ID NO: 92663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatttcctacttgacattat

SEQ ID NO: 92664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttcctacttgacattatc

SEQ ID NO: 92665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcctacttgacattatct

SEQ ID NO: 92666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctacttgacattatctctg

SEQ ID NO: 92667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacttgacattatctctgt

SEQ ID NO: 92668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttgacattatctctgtttt

SEQ ID NO: 92669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacattatctctgttttttt

SEQ ID NO: 92670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acattatctctgtttttttt

SEQ ID NO: 92671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctctgttttttttctactt

SEQ ID NO: 92672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttttttttctactttgtt

SEQ ID NO: 92673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttttttctactttgttaa

SEQ ID NO: 92674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttctactttgttaaagc

SEQ ID NO: 92675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttctactttgttaaagct

SEQ ID NO: 92676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctactttgttaaagcta

SEQ ID NO: 92677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctactttgttaaagctat

SEQ ID NO: 92678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctactttgttaaagctata

SEQ ID NO: 92679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctactttgttaaagctatag

SEQ ID NO: 92680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactttgttaaagctataga

SEQ ID NO: 92681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctttgttaaagctatagagg

SEQ ID NO: 92682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttaaagctatagaggaaa

SEQ ID NO: 92683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttaaagctatagaggaaaa

SEQ ID NO: 92684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaaagctatagaggaaaaa

SEQ ID NO: 92685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagctatagaggaaaaacac

SEQ ID NO: 92686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagaggaaaaacacttttaa

SEQ ID NO: 92687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaacttagtccttcaaaaa

SEQ ID NO: 92688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacttagtccttcaaaaat

SEQ ID NO: 92689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacttagtccttcaaaaatg

SEQ ID NO: 92690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttagtccttcaaaaatgc

SEQ ID NO: 92691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtccttcaaaaatgccagt

SEQ ID NO: 92692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtccttcaaaaatgccagtt

SEQ ID NO: 92693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaaatgccagttttctat

SEQ ID NO: 92694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaatgccagttttctata

SEQ ID NO: 92695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctatactaattttattttg

SEQ ID NO: 92696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatactaattttattttgt

SEQ ID NO: 92697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatactaattttattttgtg

SEQ ID NO: 92698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tactaattttattttgtgag

SEQ ID NO: 92699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttattttgtgagcagtg

SEQ ID NO: 92700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttgtgagcagtgggac

SEQ ID NO: 92701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttgtgagcagtgggaca

SEQ ID NO: 92702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgtgagcagtgggacag

SEQ ID NO: 92703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgagcagtgggacagttt

SEQ ID NO: 92704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgagcagtgggacagtttc

SEQ ID NO: 92705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagcagtgggacagtttca

SEQ ID NO: 92706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaacatccactcaacttac

SEQ ID NO: 92707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacatccactcaacttacc

SEQ ID NO: 92708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aacttaccatgtgaaagaca

SEQ ID NO: 92709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
accatgtgaaagacatgtat

SEQ ID NO: 92710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgtgaaagacatgtata

SEQ ID NO: 92711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctcaggccagaaagcactg

SEQ ID NO: 92712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaggccagaaagcactggc

SEQ ID NO: 92713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aggccagaaagcactggcac

SEQ ID NO: 92714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcactgtataagaatgtaag

SEQ ID NO: 92715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tataagaatgtaagaataca

SEQ ID NO: 92716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacttttgttgagaagatcc

SEQ ID NO: 92717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgttgagaagatcctgcaa

SEQ ID NO: 92718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttgagaagatcctgcaaa

SEQ ID NO: 92719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgagaagatcctgcaaac

SEQ ID NO: 92720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgagaagatcctgcaaaca

SEQ ID NO: 92721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaagatcctgcaaacagaa

SEQ ID NO: 92722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaacagaaagaaaactatt

SEQ ID NO: 92723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgaggctgaagcacacaga

SEQ ID NO: 92724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggctgaagcacacagatta

SEQ ID NO: 92725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagcacacagattaagatag

SEQ ID NO: 92726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agatagggaaagagggaaga

SEQ ID NO: 92727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acatggtgtagggctggaaa

SEQ ID NO: 92728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaagcttgtagaacttgta

SEQ ID NO: 92729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagaacttgtagacagtaa

SEQ ID NO: 92730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaacttgtagacagtaat

SEQ ID NO: 92731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagacagtaatagtataga

SEQ ID NO: 92732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagacagtaatagtatagag

SEQ ID NO: 92733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaaatctttgctgaggat

SEQ ID NO: 92734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaatctttgctgaggatt

SEQ ID NO: 92735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctgaggattttagaattt

SEQ ID NO: 92736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgaggattttagaattta

SEQ ID NO: 92737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgaggattttagaatttat

SEQ ID NO: 92738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggattttagaatttatcat

SEQ ID NO: 92739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaatttatcatcataata

SEQ ID NO: 92740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatttatcatcataataa

SEQ ID NO: 92741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatttatcatcataataat

SEQ ID NO: 92742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcatcataataatggagaa

SEQ ID NO: 92743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatcataataatggagaaa

SEQ ID NO: 92744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagaattttatgccggaaaa

SEQ ID NO: 92745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgccggaaaatgacccaa

SEQ ID NO: 92746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgccggaaaatgacccaaa

SEQ ID NO: 92747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgccggaaaatgacccaaaa

SEQ ID NO: 92748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagcagggaaatgtcacaa

SEQ ID NO: 92749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcagggaaatgtcacaac

SEQ ID NO: 92750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcagggaaatgtcacaacc

SEQ ID NO: 92751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataaaatccactctggctac

SEQ ID NO: 92752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggctactgtactgagaata

SEQ ID NO: 92753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctactgtactgagaataga

SEQ ID NO: 92754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgtactgagaatagatttg

SEQ ID NO: 92755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tactgagaatagatttggaa

SEQ ID NO: 92756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaatagatttggaagtgag

SEQ ID NO: 92757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaagtgaggcaagaatgga

SEQ ID NO: 92758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaagtgaggcaagaatggat

SEQ ID NO: 92759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtaagataaaacaagtagg

SEQ ID NO: 92760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtaagataaaacaagtaggt

SEQ ID NO: 92761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttacattgtcttataaagag

SEQ ID NO: 92762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattgtcttataaagaggtt

SEQ ID NO: 92763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttataaagaggttaaagg

SEQ ID NO: 92764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataaagaggttaaaggtggt

SEQ ID NO: 92765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaagaggttaaaggtggta

SEQ ID NO: 92766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggtggtaatggattggat

SEQ ID NO: 92767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattaggtgttgacagtgga

SEQ ID NO: 92768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtgttgacagtggaaatta

SEQ ID NO: 92769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acagtggaaattaagagaag

SEQ ID NO: 92770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagaagttgatgtatttac

SEQ ID NO: 92771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgtatttacattacattag

SEQ ID NO: 92772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acattacattaggtggtaga

SEQ ID NO: 92773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattacattaggtggtagaa

SEQ ID NO: 92774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattaggtggtagaatgaac

SEQ ID NO: 92775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggtggtagaatgaactggtc

SEQ ID NO: 92776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtcttggtgaataaatgcgg

SEQ ID NO: 92777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtgaataaatgcggagggt

SEQ ID NO: 92778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgaataaatgcggagggtt

SEQ ID NO: 92779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgaagaggattagtttgga

SEQ ID NO: 92780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttggaaaactggatgaat

SEQ ID NO: 92781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaaactggatgaatggtg

SEQ ID NO: 92782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaactggatgaatggtgg

SEQ ID NO: 92783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatgaatggtggtactaatc

SEQ ID NO: 92784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcaatgagaaggaagatgt

SEQ ID NO: 92785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaccatgatatacagtt

SEQ ID NO: 92786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaccatgatatacagttg

SEQ ID NO: 92787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accatgatatacagttgtcc

SEQ ID NO: 92788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgatatacagttgtccc

SEQ ID NO: 92789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcccttagtatctgctgggg

SEQ ID NO: 92790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtatctgctggggattggc

SEQ ID NO: 92791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatctgctggggattggct

SEQ ID NO: 92792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctggggattggcttctggac

SEQ ID NO: 92793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggattggcttctggactcc

SEQ ID NO: 92794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttctggactccctgagaa

SEQ ID NO: 92795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctggactccctgagaatacc

SEQ ID NO: 92796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggactccctgagaatacca

SEQ ID NO: 92797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gactccctgagaataccaaa

SEQ ID NO: 92798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctgagaataccaaaatcca

SEQ ID NO: 92799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agaataccaaaatccacaga

SEQ ID NO: 92800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaatctcttatacaaatggc

SEQ ID NO: 92801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttatacaaatggcatagtgt

SEQ ID NO: 92802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atacaaatggcatagtgttt

SEQ ID NO: 92803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacaaatggcatagtgtttg

SEQ ID NO: 92804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttataacctacacacatc

SEQ ID NO: 92805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttataacctacacacatcc

SEQ ID NO: 92806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ataacctacacacatcctcc

SEQ ID NO: 92807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taacctacacacatcctcct

SEQ ID NO: 92808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacacatcctcctatatagt

SEQ ID NO: 92809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctatatagtttaaaattacc

SEQ ID NO: 92810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatagtttaaaattacctac

SEQ ID NO: 92811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattacctacacatcact

SEQ ID NO: 92812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattacctacacatcactt

SEQ ID NO: 92813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctacacatcacttcatttg

SEQ ID NO: 92814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacatcacttcatttgtatg

SEQ ID NO: 92815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catttgtatggattcaatgt

SEQ ID NO: 92816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttgtatggattcaatgta

SEQ ID NO: 92817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatggattcaatgtagtac

SEQ ID NO: 92818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatggattcaatgtagtact

SEQ ID NO: 92819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgtagtactcagcatatg

SEQ ID NO: 92820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcatatggaaaattcaagt

SEQ ID NO: 92821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagttttgccttttggggct

SEQ ID NO: 92822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgccttttggggctttgtgg

SEQ ID NO: 92823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccttttggggctttgtgga

SEQ ID NO: 92824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccttttggggctttgtggat

SEQ ID NO: 92825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggggctttgtggattttt

SEQ ID NO: 92826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggggctttgtggatttttt

SEQ ID NO: 92827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggctttgtggattttttc

SEQ ID NO: 92828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggctttgtggattttttcc

SEQ ID NO: 92829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtggattttttccccaact

SEQ ID NO: 92830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggattttttccccaacta

SEQ ID NO: 92831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggattttttccccaactat

SEQ ID NO: 92832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccccaactatttctgat

SEQ ID NO: 92833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccccaactatttctgatc

SEQ ID NO: 92834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccccaactatttctgatcc

SEQ ID NO: 92835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccaactatttctgatcca

SEQ ID NO: 92836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccaactatttctgatccag

SEQ ID NO: 92837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttctgatccagaattggtt

SEQ ID NO: 92838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgatccagaattggttgaa

SEQ ID NO: 92839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatccagaattggttgaat

SEQ ID NO: 92840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atccagaattggttgaatcc

SEQ ID NO: 92841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttgaatccacagatcagaa

SEQ ID NO: 92842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatccacagatcagaaacca

SEQ ID NO: 92843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgcatatatatatatata

SEQ ID NO: 92844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaccatgagattagtattc

SEQ ID NO: 92845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caccatgagattagtattcc

SEQ ID NO: 92846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtattcctatagaaaaaaga

SEQ ID NO: 92847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctatagaaaaaagaagagag

SEQ ID NO: 92848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagaaaaaagaagagagacc

SEQ ID NO: 92849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actgcctcctccatttgaag

SEQ ID NO: 92850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcctccatttgaagacac

SEQ ID NO: 92851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctccatttgaagacacagtg

SEQ ID NO: 92852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catttgaagacacagtgaga

SEQ ID NO: 92853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagacacagtgagaatgct

SEQ ID NO: 92854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagacacagtgagaatgctg

SEQ ID NO: 92855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccctctgccagccaggaaat

SEQ ID NO: 92856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgccagccaggaaatgagcc

SEQ ID NO: 92857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccagccaggaaatgagccct

SEQ ID NO: 92858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actggggaacgaaattggct

SEQ ID NO: 92859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gggaacgaaattggctggcg

SEQ ID NO: 92860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctggcgccttaatcttgga

SEQ ID NO: 92861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcgccttaatcttggactcc

SEQ ID NO: 92862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatcttggactcctcagcct

SEQ ID NO: 92863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcttggactcctcagcctc

SEQ ID NO: 92864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggactcctcagcctcgggaa

SEQ ID NO: 92865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gactcctcagcctcgggaac

SEQ ID NO: 92866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcagcctcgggaactgtta

SEQ ID NO: 92867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcgggaactgttagaa

SEQ ID NO: 92868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gggaactgttagaaataaat

SEQ ID NO: 92869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttagaaataaatttctgttg

SEQ ID NO: 92870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaataaatttctgttgttc

SEQ ID NO: 92871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgttgttctagccacccag

SEQ ID NO: 92872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttgttctagccacccagt

SEQ ID NO: 92873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgttctagccacccagtct

SEQ ID NO: 92874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttctagccacccagtctatg

SEQ ID NO: 92875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagccacccagtctatggta

SEQ ID NO: 92876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gccacccagtctatggtata

SEQ ID NO: 92877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggtatattattatgacagc

SEQ ID NO: 92878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatgacagccccagctttc

SEQ ID NO: 92879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgacagccccagctttctaa

SEQ ID NO: 92880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctaagaccaacacaaaaat

SEQ ID NO: 92881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaagaccaacacaaaaatg

SEQ ID NO: 92882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagaccaacacaaaaatga

SEQ ID NO: 92883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaccaacacaaaaatgata

SEQ ID NO: 92884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tggctcctgctattgcttta

SEQ ID NO: 92885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctcctgctattgctttaag

SEQ ID NO: 92886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgctattgctttaagtaat

SEQ ID NO: 92887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctattgctttaagtaataat

SEQ ID NO: 92888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgctttaagtaataatcta

SEQ ID NO: 92889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttaagtaataatctatta

SEQ ID NO: 92890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taagtaataatctattatta

SEQ ID NO: 92891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtaataatctattattat

SEQ ID NO: 92892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtaataatctattattatc

SEQ ID NO: 92893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttattatctctgactcctga

SEQ ID NO: 92894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatctctgactcctgagtc

SEQ ID NO: 92895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctctgactcctgagtctca

SEQ ID NO: 92896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgactcctgagtctcatgtc

SEQ ID NO: 92897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actcctgagtctcatgtctt

SEQ ID NO: 92898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgagtctcatgtcttctgc

SEQ ID NO: 92899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agtctcatgtcttctgcaag

SEQ ID NO: 92900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgtcttctgcaagcatgta

SEQ ID NO: 92901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgcaagcatgtaacatgct

SEQ ID NO: 92902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcaagcatgtaacatgcta

SEQ ID NO: 92903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caagcatgtaacatgctaaa

SEQ ID NO: 92904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtgaattatgttactcta

SEQ ID NO: 92905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttactctaagagtgaaat

SEQ ID NO: 92906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctaagagtgaaatatata

SEQ ID NO: 92907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taagagtgaaatatataatg

SEQ ID NO: 92908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agagtgaaatatataatgca

SEQ ID NO: 92909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttaaatgtattgacatag

SEQ ID NO: 92910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttaaatgtattgacataga

SEQ ID NO: 92911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatgtattgacatagaaac

SEQ ID NO: 92912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtattgacatagaaact

SEQ ID NO: 92913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acatagaaactttttatgtt

SEQ ID NO: 92914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttatgttccaaatgaaacg

SEQ ID NO: 92915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatgttccaaatgaaacgt

SEQ ID NO: 92916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgttccaaatgaaacgtt

SEQ ID NO: 92917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgttccaaatgaaacgttt

SEQ ID NO: 92918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttccaaatgaaacgtttt

SEQ ID NO: 92919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaatgaaacgttttagaag

SEQ ID NO: 92920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaagacatttgctgtaga

SEQ ID NO: 92921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaagacatttgctgtagat

SEQ ID NO: 92922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaagacatttgctgtagatt

SEQ ID NO: 92923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctgtagattctcttggcct

SEQ ID NO: 92924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtagattctcttggccta

SEQ ID NO: 92925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagattctcttggcctacat

SEQ ID NO: 92926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttggcctacattttaaag

SEQ ID NO: 92927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttggcctacattttaaaggc

SEQ ID NO: 92928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcctacattttaaaggcat

SEQ ID NO: 92929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctacattttaaaggcatg

SEQ ID NO: 92930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattttaaaggcatgagtgg

SEQ ID NO: 92931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaggcatgagtgggacaa

SEQ ID NO: 92932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaggcatgagtgggacaag

SEQ ID NO: 92933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaggcatgagtgggacaagt

SEQ ID NO: 92934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagattctctttgactttga

SEQ ID NO: 92935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agattctctttgactttgag

SEQ ID NO: 92936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttgactttgagaaaatt

SEQ ID NO: 92937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgactttgagaaaattac

SEQ ID NO: 92938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgactttgagaaaattactt

SEQ ID NO: 92939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactttgagaaaattactta

SEQ ID NO: 92940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actttgagaaaattacttaa

SEQ ID NO: 92941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgagaaaattacttaagatt

SEQ ID NO: 92942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagaaaattacttaagattg

SEQ ID NO: 92943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agaaaattacttaagattgc

SEQ ID NO: 92944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaagattgcccattttct

SEQ ID NO: 92945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagattgcccattttctttg

SEQ ID NO: 92946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agattgcccattttctttgg

SEQ ID NO: 92947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccattttctttggcttctg

SEQ ID NO: 92948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctttggcttctgggtaaaa

SEQ ID NO: 92949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttggcttctgggtaaaaa

SEQ ID NO: 92950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttggcttctgggtaaaaat

SEQ ID NO: 92951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggcttctgggtaaaaattt

SEQ ID NO: 92952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcttctgggtaaaaatttg

SEQ ID NO: 92953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttctgggtaaaaatttgt

SEQ ID NO: 92954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgggtaaaaatttgtaagg

SEQ ID NO: 92955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgggtaaaaatttgtaaggt

SEQ ID NO: 92956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtaaaaatttgtaaggtgc

SEQ ID NO: 92957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaggtgctttgccaagaa

SEQ ID NO: 92958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaggtgctttgccaagaat

SEQ ID NO: 92959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgccaagaataaggtgcact

SEQ ID NO: 92960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccaagaataaggtgcactg

SEQ ID NO: 92961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaagaataaggtgcactga

SEQ ID NO: 92962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatggtaaacacgattagga

SEQ ID NO: 92963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggatagtcaacagggaggaa

SEQ ID NO: 92964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcctttaaatttttgataa

SEQ ID NO: 92965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttaaatttttgataagat

SEQ ID NO: 92966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaatttttgataagataac

SEQ ID NO: 92967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatttttgataagataaca

SEQ ID NO: 92968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatttttgataagataacaa

SEQ ID NO: 92969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgataagataacaattaac

SEQ ID NO: 92970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgataagataacaattaaca

SEQ ID NO: 92971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataagataacaattaacat

SEQ ID NO: 92972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataagataacaattaacatt

SEQ ID NO: 92973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatttgctttctacatcag

SEQ ID NO: 92974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttctacatcagtctttt

SEQ ID NO: 92975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttctacatcagtcttttg

SEQ ID NO: 92976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctacatcagtcttttgcgg

SEQ ID NO: 92977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacatcagtcttttgcggg

SEQ ID NO: 92978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacatcagtcttttgcgggc

SEQ ID NO: 92979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catcagtcttttgcgggcga

SEQ ID NO: 92980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcgggcgagatcagtgtg

SEQ ID NO: 92981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcgggcgagatcagtgtgc

SEQ ID NO: 92982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcgggcgagatcagtgtgcc

SEQ ID NO: 92983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cgggcgagatcagtgtgcca

SEQ ID NO: 92984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctcaccagtgtccctctct

SEQ ID NO: 92985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
accagtgtccctctcttttt

SEQ ID NO: 92986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctttttacctccacagtct

SEQ ID NO: 92987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttttacctccacagtctgt

SEQ ID NO: 92988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttacctccacagtctgtat

SEQ ID NO: 92989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacctccacagtctgtatg

SEQ ID NO: 92990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacctccacagtctgtatga

SEQ ID NO: 92991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acctccacagtctgtatgag

SEQ ID NO: 92992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctccacagtctgtatgagc

SEQ ID NO: 92993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cacagtctgtatgagccatt

SEQ ID NO: 92994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgagccattgtggtttga

SEQ ID NO: 92995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggtttgataaaataacctt

SEQ ID NO: 92996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataaaataacctttctagt

SEQ ID NO: 92997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaaataacctttctagta

SEQ ID NO: 92998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctagtagcgttgctcatct

SEQ ID NO: 92999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagtagcgttgctcatctg

SEQ ID NO: 93000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagtagcgttgctcatctgt

SEQ ID NO: 93001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtagcgttgctcatctgtat

SEQ ID NO: 93002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcatctgtatttctacctt

SEQ ID NO: 93003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atctgtatttctaccttaac

SEQ ID NO: 93004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatttctaccttaacatggt

SEQ ID NO: 93005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaccttaacatggtacatt

SEQ ID NO: 93006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taccttaacatggtacattg

SEQ ID NO: 93007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccttaacatggtacattgga

SEQ ID NO: 93008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacatggtacattggaaaac

SEQ ID NO: 93009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatggtacattggaaaaca

SEQ ID NO: 93010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaacaggagcatgcattt

SEQ ID NO: 93011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtttgatcctttgtaaca

SEQ ID NO: 93012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtttgatcctttgtaacaa

SEQ ID NO: 93013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatcctttgtaacaaatgat

SEQ ID NO: 93014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcctttgtaacaaatgatc

SEQ ID NO: 93015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtaacaaatgatcacaaat

SEQ ID NO: 93016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaacaaatgatcacaaatt

SEQ ID NO: 93017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacaaatgatcacaaattt

SEQ ID NO: 93018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcagcttaaaataatacaa

SEQ ID NO: 93019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcagcttaaaataatacaaa

SEQ ID NO: 93020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaataatacaaatgtatta

SEQ ID NO: 93021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaataatacaaatgtattat

SEQ ID NO: 93022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctcacaatttttgtgaggc

SEQ ID NO: 93023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaatttttgtgaggcagga

SEQ ID NO: 93024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgaggcaggagcctggg

SEQ ID NO: 93025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgaggcaggagcctgggt

SEQ ID NO: 93026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaggcaggagcctgggta

SEQ ID NO: 93027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaggcaggagcctgggtat

SEQ ID NO: 93028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtatagttatctgtgtttt

SEQ ID NO: 93029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgtgttttgtataaagac

SEQ ID NO: 93030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttttgtataaagacacat

SEQ ID NO: 93031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtataaagacacatgtaac

SEQ ID NO: 93032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtataaagacacatgtaacc

SEQ ID NO: 93033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tataaagacacatgtaaccc

SEQ ID NO: 93034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attttttctgttctgttaga

SEQ ID NO: 93035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttttctgttctgttagaa

SEQ ID NO: 93036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctgttctgttagaagga

SEQ ID NO: 93037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgttctgttagaaggaa

SEQ ID NO: 93038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgttctgttagaaggaat

SEQ ID NO: 93039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgttctgttagaaggaatt

SEQ ID NO: 93040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttctgttagaaggaatta

SEQ ID NO: 93041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctgttagaaggaattagt

SEQ ID NO: 93042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttagaaggaattagtgta

SEQ ID NO: 93043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttagaaggaattagtgtatc

SEQ ID NO: 93044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaggaattagtgtatcaca

SEQ ID NO: 93045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgtatcacagttggtttat

SEQ ID NO: 93046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtttatatccttttcttata

SEQ ID NO: 93047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatccttttcttatatgag

SEQ ID NO: 93048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatccttttcttatatgagc

SEQ ID NO: 93049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcttatatgagcaagatat

SEQ ID NO: 93050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttatatgagcaagatatc

SEQ ID NO: 93051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatatgagcaagatatca

SEQ ID NO: 93052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatatgagcaagatatcat

SEQ ID NO: 93053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatgagcaagatatcattc

SEQ ID NO: 93054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgagcaagatatcattct

SEQ ID NO: 93055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttctcatataaaaatgagc

SEQ ID NO: 93056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctcatataaaaatgagcag

SEQ ID NO: 93057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcatataaaaatgagcagt

SEQ ID NO: 93058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcatataaaaatgagcagtt

SEQ ID NO: 93059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atataaaaatgagcagttct

SEQ ID NO: 93060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaagagtagcctaagaaca

SEQ ID NO: 93061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagagtagcctaagaacagg

SEQ ID NO: 93062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaacaggagaaagcacatt

SEQ ID NO: 93063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacatattgtcaatgtaca

SEQ ID NO: 93064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacatattgtcaatgtacag

SEQ ID NO: 93065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatattgtcaatgtacaga

SEQ ID NO: 93066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaatgtacagagtagaaga

SEQ ID NO: 93067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagagagtaaatctggagg

SEQ ID NO: 93068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagagagtaaatctggaggc

SEQ ID NO: 93069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaggctcctcagatgaaggg

SEQ ID NO: 93070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcagatgaagggccagcca

SEQ ID NO: 93071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agatgaagggccagccataa

SEQ ID NO: 93072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttaaagcagcacatgcaa

SEQ ID NO: 93073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttaaagcagcacatgcaaa

SEQ ID NO: 93074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagcagcacatgcaaatcc

SEQ ID NO: 93075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagcagcacatgcaaatcca

SEQ ID NO: 93076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttctcacatatttagaaa

SEQ ID NO: 93077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcacatatttagaaatagta

SEQ ID NO: 93078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acatatttagaaatagtaat

SEQ ID NO: 93079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaaatagtaatttaatggg

SEQ ID NO: 93080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaatagtaatttaatggga

SEQ ID NO: 93081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatgggagtgtattcttaat

SEQ ID NO: 93082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgggagtgtattcttaata

SEQ ID NO: 93083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaatattcactggatataa

SEQ ID NO: 93084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatattcactggatataatt

SEQ ID NO: 93085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattcactggatataattt

SEQ ID NO: 93086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actggatataattttcccat

SEQ ID NO: 93087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatataattttcccataaat

SEQ ID NO: 93088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcccataaattctaaatttt

SEQ ID NO: 93089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccataaattctaaatttta

SEQ ID NO: 93090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccataaattctaaattttac

SEQ ID NO: 93091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaattttacacatcactaa

SEQ ID NO: 93092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattttacacatcactaaaa

SEQ ID NO: 93093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacacatcactaaaaataaa

SEQ ID NO: 93094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acacatcactaaaaataaaa

SEQ ID NO: 93095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacatcactaaaaataaaaa

SEQ ID NO: 93096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaataaaaatgaattatga

SEQ ID NO: 93097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatggtatattagagaaga

SEQ ID NO: 93098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaagaattatatttttat

SEQ ID NO: 93099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttttatagaaagaatat

SEQ ID NO: 93100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatagaaagaatatgactg

SEQ ID NO: 93101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagaaagaatatgactga

SEQ ID NO: 93102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagaaagaatatgactgaa

SEQ ID NO: 93103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagaaagaatatgactgaac

SEQ ID NO: 93104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aactaacttgaagacatatt

SEQ ID NO: 93105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acttgaagacatattgtttt

SEQ ID NO: 93106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagacatattgttttgtag

SEQ ID NO: 93107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagacatattgttttgtagg

SEQ ID NO: 93108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttgtaggaaataaaataa

SEQ ID NO: 93109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaggaaataaaataaaaa

SEQ ID NO: 93110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaggaaataaaataaaaac

SEQ ID NO: 93111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taggaaataaaataaaaact

SEQ ID NO: 93112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtcatgccagcaaatatta

SEQ ID NO: 93113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caacttacgaataacttttg

SEQ ID NO: 93114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acgaataacttttgctcagt

SEQ ID NO: 93115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgaataacttttgctcagtt

SEQ ID NO: 93116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgctcagttctactagatt

SEQ ID NO: 93117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctcagttctactagattt

SEQ ID NO: 93118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcagttctactagatttg

SEQ ID NO: 93119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcagttctactagatttgc

SEQ ID NO: 93120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agttctactagatttgcaaa

SEQ ID NO: 93121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tactagatttgcaaaatttt

SEQ ID NO: 93122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctagatttgcaaaattttta

SEQ ID NO: 93123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatttgcaaaatttttaaca

SEQ ID NO: 93124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaaaatttttaacaagctc

SEQ ID NO: 93125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaaatttttaacaagctct

SEQ ID NO: 93126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaacaagctctgaacattt

SEQ ID NO: 93127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacaagctctgaacatttt

SEQ ID NO: 93128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacaagctctgaacattttc

SEQ ID NO: 93129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaagctctgaacattttct

SEQ ID NO: 93130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaacattttctgtatactt

SEQ ID NO: 93131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacattttctgtatacttat

SEQ ID NO: 93132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtatacttattgtgcat

SEQ ID NO: 93133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtatacttattgtgcatt

SEQ ID NO: 93134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtatacttattgtgcattg

SEQ ID NO: 93135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatacttattgtgcattgct

SEQ ID NO: 93136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attgtgcattgcttttatct

SEQ ID NO: 93137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgtgcattgcttttatctt

SEQ ID NO: 93138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcattgcttttatcttttg

SEQ ID NO: 93139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttttatcttttgtttctaa

SEQ ID NO: 93140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatcttttgtttctaaaga

SEQ ID NO: 93141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttttgtttctaaagat

SEQ ID NO: 93142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttttgtttctaaagata

SEQ ID NO: 93143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttttgtttctaaagatat

SEQ ID NO: 93144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtttctaaagatatattt

SEQ ID NO: 93145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtttctaaagatatattta

SEQ ID NO: 93146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttctaaagatatatttaa

SEQ ID NO: 93147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttctaaagatatatttaaa

SEQ ID NO: 93148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaaagatatatttaaaaag

SEQ ID NO: 93149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaagatatatttaaaaaga

SEQ ID NO: 93150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagatatatttaaaaagatt

SEQ ID NO: 93151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaagattcaagctaaagt

SEQ ID NO: 93152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagattcaagctaaagtg

SEQ ID NO: 93153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagctaaagtgcaatgatgc

SEQ ID NO: 93154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtgcaatgatgcagttat

SEQ ID NO: 93155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaccaatgtctcataaatc

SEQ ID NO: 93156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaatgtctcataaatctct

SEQ ID NO: 93157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataaatctcttcaaattacc

SEQ ID NO: 93158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcaaattaccttttcgcag

SEQ ID NO: 93159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaattaccttttcgcagac

SEQ ID NO: 93160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattaccttttcgcagaca

SEQ ID NO: 93161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccttttcgcagacagatcaa

SEQ ID NO: 93162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcgcagacagatcaattat

SEQ ID NO: 93163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcgcagacagatcaattatt

SEQ ID NO: 93164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgcagacagatcaattatta

SEQ ID NO: 93165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gcagacagatcaattattaa

SEQ ID NO: 93166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatgtaggtatggctcgc

SEQ ID NO: 93167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgtaggtatggctcgcaga

SEQ ID NO: 93168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gcagagtaatagggagtcaa

SEQ ID NO: 93169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtgtagcatgtgagctcta

SEQ ID NO: 93170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattgcttgtttataactat

SEQ ID NO: 93171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgcttgtttataactatca

SEQ ID NO: 93172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgtttataactatcaatt

SEQ ID NO: 93173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttataactatcaattatt

SEQ ID NO: 93174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttataactatcaattattc

SEQ ID NO: 93175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataactatcaattattcatg

SEQ ID NO: 93176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taactatcaattattcatgt

SEQ ID NO: 93177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaattattcatgtttcatt

SEQ ID NO: 93178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatgtttcatttcctgtg

SEQ ID NO: 93179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtttcatttcctgtgtgc

SEQ ID NO: 93180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catttcctgtgtgcatcaaa

SEQ ID NO: 93181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttcctgtgtgcatcaaat

SEQ ID NO: 93182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgtgtgcatcaaatacta

SEQ ID NO: 93183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtgtgcatcaaatactat

SEQ ID NO: 93184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtgcatcaaatactattgc

SEQ ID NO: 93185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgcagcaaaatcccctctg

SEQ ID NO: 93186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagcaaaatcccctctgctc

SEQ ID NO: 93187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctctagctagtatgtaat

SEQ ID NO: 93188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctctagctagtatgtaattt

SEQ ID NO: 93189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagctagtatgtaatttctc

SEQ ID NO: 93190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctagtatgtaatttctccc

SEQ ID NO: 93191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtatgtaatttctccctccc

SEQ ID NO: 93192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccctcccttgagagagat

SEQ ID NO: 93193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccctcccttgagagagatt

SEQ ID NO: 93194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctcccttgagagagattac

SEQ ID NO: 93195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccttgagagagattaccatg

SEQ ID NO: 93196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagagagattaccatgtatc

SEQ ID NO: 93197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agagagattaccatgtatcc

SEQ ID NO: 93198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgtatcctgcagctcat

SEQ ID NO: 93199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagctcattttgcttgggtt

SEQ ID NO: 93200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttgcttgggttatggca

SEQ ID NO: 93201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcttgggttatggcatagc

SEQ ID NO: 93202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttgggttatggcatagca

SEQ ID NO: 93203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgggttatggcatagcat

SEQ ID NO: 93204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggttatggcatagcattat

SEQ ID NO: 93205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttatggcatagcattatc

SEQ ID NO: 93206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcatagcattatctacaa

SEQ ID NO: 93207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctacaatgtgaaagaattt

SEQ ID NO: 93208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatgtgaaagaatttagct

SEQ ID NO: 93209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctttgttgttgtaaaaaa

SEQ ID NO: 93210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctttgttgttgtaaaaaat

SEQ ID NO: 93211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttgttgtaaaaaatttgc

SEQ ID NO: 93212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgttgtaaaaaatttgca

SEQ ID NO: 93213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgttgtaaaaaatttgcat

SEQ ID NO: 93214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgtaaaaaatttgcatgta

SEQ ID NO: 93215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaaaatttgcatgtatca

SEQ ID NO: 93216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcatgtatcacaatcactta

SEQ ID NO: 93217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catgtatcacaatcacttat

SEQ ID NO: 93218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgttgaaatggattacagt

SEQ ID NO: 93219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttgaaatggattacagta

SEQ ID NO: 93220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatggattacagtattatt

SEQ ID NO: 93221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagtattattcagtgattat

SEQ ID NO: 93222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcagtgattataattctat

SEQ ID NO: 93223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgattataattctatttt

SEQ ID NO: 93224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taattctattttgcagagtg

SEQ ID NO: 93225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattttgcagagtggctatt

SEQ ID NO: 93226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttgcagagtggctattgc

SEQ ID NO: 93227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcagagtggctattgcaac

SEQ ID NO: 93228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagagtggctattgcaact

SEQ ID NO: 93229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagagtggctattgcaacta

SEQ ID NO: 93230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgcaactatcagtacaaaa

SEQ ID NO: 93231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caactatcagtacaaaagtc

SEQ ID NO: 93232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcagtacaaaagtcccaagg

SEQ ID NO: 93233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttacaccttttacatgct

SEQ ID NO: 93234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacaccttttacatgctatt

SEQ ID NO: 93235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaccttttacatgctatta

SEQ ID NO: 93236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caccttttacatgctattaa

SEQ ID NO: 93237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttacatgctattaagataac

SEQ ID NO: 93238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacatgctattaagataaca

SEQ ID NO: 93239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatgctattaagataacat

SEQ ID NO: 93240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgctattaagataacata

SEQ ID NO: 93241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaagataacataaaagttg

SEQ ID NO: 93242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agataacataaaagttgaaa

SEQ ID NO: 93243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaataatggcctagtatggc

SEQ ID NO: 93244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtatggcaattatttttaga

SEQ ID NO: 93245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttagaatatcttaccta

SEQ ID NO: 93246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagaatatcttacctaatg

SEQ ID NO: 93247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaatatcttacctaatga

SEQ ID NO: 93248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatatcttacctaatgac

SEQ ID NO: 93249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatatcttacctaatgacc

SEQ ID NO: 93250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctaatgaccatcaacagg

SEQ ID NO: 93251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctaatgaccatcaacagga

SEQ ID NO: 93252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgaccatcaacaggacttg

SEQ ID NO: 93253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatgcttatagctaaagtag

SEQ ID NO: 93254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgcttatagctaaagtaga

SEQ ID NO: 93255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atagctaaagtagagggttg

SEQ ID NO: 93256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagctaaagtagagggttgt

SEQ ID NO: 93257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagtagagggttgtattaat

SEQ ID NO: 93258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattaattactcagctaaaa

SEQ ID NO: 93259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attactcagctaaaaatggt

SEQ ID NO: 93260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcagctaaaaatggtaaga

SEQ ID NO: 93261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agctaaaaatggtaagaacc

SEQ ID NO: 93262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatggtaagaaccacctc

SEQ ID NO: 93263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cactttttggaaataagcta

SEQ ID NO: 93264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttggaaataagctagacct

SEQ ID NO: 93265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggaaataagctagacctt

SEQ ID NO: 93266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggaaataagctagaccttt

SEQ ID NO: 93267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaataagctagaccttta

SEQ ID NO: 93268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaataagctagacctttat

SEQ ID NO: 93269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gacctttataaatgtgcata

SEQ ID NO: 93270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tataaatgtgcatatttcct

SEQ ID NO: 93271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaatgtgcatatttcctg

SEQ ID NO: 93272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaatgtgcatatttcctga

SEQ ID NO: 93273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgattttaatatgttgtt

SEQ ID NO: 93274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgattttaatatgttgttt

SEQ ID NO: 93275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
attttaatatgttgtttgaa

SEQ ID NO: 93276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatatgttgtttgaattca

SEQ ID NO: 93277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatatgttgtttgaattcat

SEQ ID NO: 93278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatgttgtttgaattcata

SEQ ID NO: 93279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttgaattcataaatctcaa

SEQ ID NO: 93280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaattcataaatctcaaaag

SEQ ID NO: 93281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattcataaatctcaaaagt

SEQ ID NO: 93282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaatctcaaaagtagcta

SEQ ID NO: 93283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaagtagctaaattttgaa

SEQ ID NO: 93284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattttgaaatatttggtgt

SEQ ID NO: 93285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaatatttggtgtatatg

SEQ ID NO: 93286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaatatttggtgtatatgc

SEQ ID NO: 93287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatatttggtgtatatgcc

SEQ ID NO: 93288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtgtatatgccacatcact

SEQ ID NO: 93289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgtatatgccacatcacta

SEQ ID NO: 93290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatatttactacctaccaat

SEQ ID NO: 93291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actacctaccaatgggtgca

SEQ ID NO: 93292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctacctaccaatgggtgcat

SEQ ID NO: 93293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctaccaatgggtgcataaa

SEQ ID NO: 93294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccaatgggtgcataaaactc

SEQ ID NO: 93295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttgggcactatagttata

SEQ ID NO: 93296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgggcactatagttatact

SEQ ID NO: 93297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgggcactatagttatactt

SEQ ID NO: 93298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggcactatagttatactta

SEQ ID NO: 93299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggcactatagttatacttac

SEQ ID NO: 93300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagttatacttacccatata

SEQ ID NO: 93301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacttacccatataaaatag

SEQ ID NO: 93302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acccatataaaatagagaaa

SEQ ID NO: 93303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccatataaaatagagaaaa

SEQ ID NO: 93304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcattatttaacattcatga

SEQ ID NO: 93305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaacattcatgaagagtg

SEQ ID NO: 93306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacattcatgaagagtgcat

SEQ ID NO: 93307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattcatgaagagtgcatt

SEQ ID NO: 93308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaagagtgcattgttcct

SEQ ID NO: 93309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcctgtatgatacagaggt

SEQ ID NO: 93310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtatgatacagaggtagc

SEQ ID NO: 93311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgatacagaggtagcctg

SEQ ID NO: 93312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggttcttacatttttagtag

SEQ ID NO: 93313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttacatttttagtagcaaat

SEQ ID NO: 93314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acatttttagtagcaaatta

SEQ ID NO: 93315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catttttagtagcaaattaa

SEQ ID NO: 93316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagtagcaaattaattgcc

SEQ ID NO: 93317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtagcaaattaattgcca

SEQ ID NO: 93318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtagcaaattaattgccat

SEQ ID NO: 93319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagcaaattaattgccata

SEQ ID NO: 93320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgccatactaactactct

SEQ ID NO: 93321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccatactaactactcttact

SEQ ID NO: 93322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actactcttactactaatat

SEQ ID NO: 93323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcttactactaatataaat

SEQ ID NO: 93324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttactactaatataaatttt

SEQ ID NO: 93325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actactaatataaattttca

SEQ ID NO: 93326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctactaatataaattttcaa

SEQ ID NO: 93327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaatataaattttcaatgt

SEQ ID NO: 93328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atataaattttcaatgtgtt

SEQ ID NO: 93329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaatgtgttttcagtcatt

SEQ ID NO: 93330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatgtgttttcagtcattg

SEQ ID NO: 93331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgtgttttcagtcattgt

SEQ ID NO: 93332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagtcattgttttaatttc

SEQ ID NO: 93333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagtcattgttttaatttct

SEQ ID NO: 93334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtcattgttttaatttctt

SEQ ID NO: 93335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttaatttcttcatgaagc

SEQ ID NO: 93336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatttcttcatgaagcttg

SEQ ID NO: 93337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttcttcatgaagcttgt

SEQ ID NO: 93338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttcttcatgaagcttgtc

SEQ ID NO: 93339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcatgaagcttgtctcat

SEQ ID NO: 93340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcatgaagcttgtctcatt

SEQ ID NO: 93341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catgaagcttgtctcattct

SEQ ID NO: 93342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaagcttgtctcattcta

SEQ ID NO: 93343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctcattctatcattacaa

SEQ ID NO: 93344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctcattctatcattacaac

SEQ ID NO: 93345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attctatcattacaaccaca

SEQ ID NO: 93346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatcattacaaccacataat

SEQ ID NO: 93347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcattacaaccacataatga

SEQ ID NO: 93348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaccacataatgaagtagt

SEQ ID NO: 93349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttctcctcattttatagata

SEQ ID NO: 93350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcctcattttatagataag

SEQ ID NO: 93351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctcattttatagataaga

SEQ ID NO: 93352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctcattttatagataagaaa

SEQ ID NO: 93353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attttatagataagaaagtt

SEQ ID NO: 93354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatagataagaaagttgagg

SEQ ID NO: 93355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagataagaaagttgaggc

SEQ ID NO: 93356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagataagaaagttgaggcc

SEQ ID NO: 93357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggcccatataggttaaaga

SEQ ID NO: 93358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaatgtattcagcaaact

SEQ ID NO: 93359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcaaactcatagggtcatg

SEQ ID NO: 93360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atagggtcatggcttaactg

SEQ ID NO: 93361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aactgggatacaaatatagt

SEQ ID NO: 93362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actgggatacaaatatagtt

SEQ ID NO: 93363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggatacaaatatagttctag

SEQ ID NO: 93364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagtcttagaacccatgctc

SEQ ID NO: 93365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gtcttagaacccatgctctt

SEQ ID NO: 93366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaacccatgctcttagcca

SEQ ID NO: 93367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaacccatgctcttagccat

SEQ ID NO: 93368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttagccattatgtatgctat

SEQ ID NO: 93369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agccattatgtatgctatat

SEQ ID NO: 93370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccattatgtatgctatatc

SEQ ID NO: 93371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtatgctatatcacctctt

SEQ ID NO: 93372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatcacctcttaagagctgg

SEQ ID NO: 93373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaagagctggtacagcttt

SEQ ID NO: 93374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagagctggtacagctttcc

SEQ ID NO: 93375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagctggtacagctttccc

SEQ ID NO: 93376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtacagctttcccatctgta

SEQ ID NO: 93377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcccatctgtaaaatgagaa

SEQ ID NO: 93378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccatctgtaaaatgagaaa

SEQ ID NO: 93379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccatctgtaaaatgagaaaa

SEQ ID NO: 93380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaaatgagaaaaagagtaa

SEQ ID NO: 93381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catgtggttgtaagggtaga

SEQ ID NO: 93382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagggtagaatgagacaag

SEQ ID NO: 93383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacaaagaaattagaacaat

SEQ ID NO: 93384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaacaatgacaatacagaat

SEQ ID NO: 93385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattagtagtaatagtagt

SEQ ID NO: 93386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattagtagtaatagtagtt

SEQ ID NO: 93387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagtaatagtagttagtat

SEQ ID NO: 93388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtatgacaaccaatttgcta

SEQ ID NO: 93389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctactaaaaatgtaagaat

SEQ ID NO: 93390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctactaaaaatgtaagaatc

SEQ ID NO: 93391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctaaaaatgtaagaatccag

SEQ ID NO: 93392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaatgtaagaatccaggct

SEQ ID NO: 93393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttctgtgtcatacaggaac

SEQ ID NO: 93394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtgtcatacaggaacaat

SEQ ID NO: 93395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgtcatacaggaacaatg

SEQ ID NO: 93396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtcatacaggaacaatgca

SEQ ID NO: 93397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catgaaccaaagctcttagc

SEQ ID NO: 93398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttagccattatgtatgctac

SEQ ID NO: 93399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agccattatgtatgctacac

SEQ ID NO: 93400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccattatgtatgctacacc

SEQ ID NO: 93401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtatgctacaccacctctt

SEQ ID NO: 93402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caccacctcttaatgctatt

SEQ ID NO: 93403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaatgctattacacaaaaa

SEQ ID NO: 93404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatgctattacacaaaaatg

SEQ ID NO: 93405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atgctattacacaaaaatgt

SEQ ID NO: 93406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttacacaaaaatgtagacat

SEQ ID NO: 93407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacaaaaatgtagacatcgc

SEQ ID NO: 93408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtggctagatgtttgcata

SEQ ID NO: 93409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatgtttgcatatttttgct

SEQ ID NO: 93410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcatatttttgcttcctgtc

SEQ ID NO: 93411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catatttttgcttcctgtct

SEQ ID NO: 93412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgcttcctgtctcaatttt

SEQ ID NO: 93413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcttcctgtctcaattttc

SEQ ID NO: 93414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttcctgtctcaattttct

SEQ ID NO: 93415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttcctgtctcaattttctc

SEQ ID NO: 93416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctgtctcaattttctccct

SEQ ID NO: 93417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgtctcaattttctccctt

SEQ ID NO: 93418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctcaattttctccctttgc

SEQ ID NO: 93419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aattttctccctttgcacaa

SEQ ID NO: 93420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctccctttgcacaaacctt

SEQ ID NO: 93421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctccctttgcacaaaccttg

SEQ ID NO: 93422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccctttgcacaaaccttga

SEQ ID NO: 93423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctttgcacaaaccttgatg

SEQ ID NO: 93424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcacaaaccttgatgtgga

SEQ ID NO: 93425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcacaaaccttgatgtggat

SEQ ID NO: 93426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacaaaccttgatgtggatt

SEQ ID NO: 93427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatgtggatttcaagaaatt

SEQ ID NO: 93428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgtggatttcaagaaatta

SEQ ID NO: 93429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagaaattactttggaact

SEQ ID NO: 93430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaaattactttggaactc

SEQ ID NO: 93431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttggaactctagattctt

SEQ ID NO: 93432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaactctagattctttgt

SEQ ID NO: 93433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaactctagattctttgtc

SEQ ID NO: 93434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaactctagattctttgtcc

SEQ ID NO: 93435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagattctttgtccttgtct

SEQ ID NO: 93436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gattctttgtccttgtcttt

SEQ ID NO: 93437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgtccttgtctttgtttc

SEQ ID NO: 93438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtccttgtctttgtttccc

SEQ ID NO: 93439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtccttgtctttgtttcccg

SEQ ID NO: 93440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tccttgtctttgtttcccgg

SEQ ID NO: 93441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtctttgtttcccgggaaca

SEQ ID NO: 93442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctttgtttcccgggaacac

SEQ ID NO: 93443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtttcccgggaacacttct

SEQ ID NO: 93444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttcccgggaacacttctt

SEQ ID NO: 93445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttcccgggaacacttctta

SEQ ID NO: 93446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cccgggaacacttcttatgg

SEQ ID NO: 93447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ccgggaacacttcttatgga

SEQ ID NO: 93448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttatggaggacatttgaag

SEQ ID NO: 93449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatggaggacatttgaagc

SEQ ID NO: 93450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atggaggacatttgaagctg

SEQ ID NO: 93451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggaggacatttgaagctgt

SEQ ID NO: 93452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaagctgtcctttcaatgaa

SEQ ID NO: 93453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagctgtcctttcaatgaaa

SEQ ID NO: 93454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcctttcaatgaaaaggaaa

SEQ ID NO: 93455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaatgaaaaggaaaaagct

SEQ ID NO: 93456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatgaaaaggaaaaagcta

SEQ ID NO: 93457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgaaaaggaaaaagctat

SEQ ID NO: 93458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcagttgttgcaacttattt

SEQ ID NO: 93459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgcaacttatttagatatc

SEQ ID NO: 93460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caacttatttagatatccac

SEQ ID NO: 93461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttagatatccactgactt

SEQ ID NO: 93462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttagatatccactgacttt

SEQ ID NO: 93463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agatatccactgactttacc

SEQ ID NO: 93464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gatatccactgactttaccc

SEQ ID NO: 93465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actttacccacctatggtta

SEQ ID NO: 93466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacccacctatggttattct

SEQ ID NO: 93467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acccacctatggttattcta

SEQ ID NO: 93468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccacctatggttattctaa

SEQ ID NO: 93469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tggttattctaactgaaaca

SEQ ID NO: 93470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctaactgaaacagaaaat

SEQ ID NO: 93471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taactgaaacagaaaatacg

SEQ ID NO: 93472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actgaaacagaaaatacgtg

SEQ ID NO: 93473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaacagaaaatacgtgtaaa

SEQ ID NO: 93474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttgtataacttttatt

SEQ ID NO: 93475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttgtataacttttattc

SEQ ID NO: 93476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgtataacttttattct

SEQ ID NO: 93477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtataacttttattcttag

SEQ ID NO: 93478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtataacttttattcttaga

SEQ ID NO: 93479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tataacttttattcttagat

SEQ ID NO: 93480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattcttagattatattac

SEQ ID NO: 93481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattcttagattatattaca

SEQ ID NO: 93482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcttagattatattacaa

SEQ ID NO: 93483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcttagattatattacaat

SEQ ID NO: 93484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttagattatattacaatgtg

SEQ ID NO: 93485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agattatattacaatgtgtc

SEQ ID NO: 93486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gattatattacaatgtgtca

SEQ ID NO: 93487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattacaatgtgtcagtctc

SEQ ID NO: 93488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caatgtgtcagtctcaagta

SEQ ID NO: 93489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtataactacaatataac

SEQ ID NO: 93490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatataactacaatataat

SEQ ID NO: 93491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatataatttatggcaaac

SEQ ID NO: 93492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atggcaaactcaaacatttt

SEQ ID NO: 93493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggcaaactcaaacattttg

SEQ ID NO: 93494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaacattttgagcattcata

SEQ ID NO: 93495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagcattcatagatctatg

SEQ ID NO: 93496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagcattcatagatctatga

SEQ ID NO: 93497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcattcatagatctatgaa

SEQ ID NO: 93498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atagatctatgaaatttgta

SEQ ID NO: 93499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaaatttgtaaagaatcct

SEQ ID NO: 93500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaagaatcctatgtaaac

SEQ ID NO: 93501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaagaatcctatgtaaaca

SEQ ID NO: 93502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtaaacagctttatgatat

SEQ ID NO: 93503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatgatattcatggctattt

SEQ ID NO: 93504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgatattcatggctattta

SEQ ID NO: 93505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatattcatggctatttat

SEQ ID NO: 93506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atggctatttatttattttc

SEQ ID NO: 93507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttatttattttcatgaagc

SEQ ID NO: 93508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttattttcatgaagcaat

SEQ ID NO: 93509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttattttcatgaagcaatt

SEQ ID NO: 93510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcatgaagcaattctt

SEQ ID NO: 93511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcatgaagcaattcttg

SEQ ID NO: 93512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgaagcaattcttgatt

SEQ ID NO: 93513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgaagcaattcttgattg

SEQ ID NO: 93514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaagcaattcttgattgt

SEQ ID NO: 93515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttgattgttttcctcaagaa

SEQ ID NO: 93516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gattgttttcctcaagaaga

SEQ ID NO: 93517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attgttttcctcaagaagat

SEQ ID NO: 93518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttcctcaagaagataata

SEQ ID NO: 93519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctcaagaagataataaca

SEQ ID NO: 93520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctcaagaagataataacat

SEQ ID NO: 93521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaagaagataataacata

SEQ ID NO: 93522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaagataataacataata

SEQ ID NO: 93523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaaaaattggtggccttc

SEQ ID NO: 93524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaattggtggccttca

SEQ ID NO: 93525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaattggtggccttcat

SEQ ID NO: 93526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaattggtggccttcata

SEQ ID NO: 93527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtggccttcatacataggtc

SEQ ID NO: 93528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catacataggtcctaaaccc

SEQ ID NO: 93529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atacataggtcctaaaccca

SEQ ID NO: 93530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacccaggccaattccctgg

SEQ ID NO: 93531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctggccatcctaatttagt

SEQ ID NO: 93532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gccatcctaatttagttggc

SEQ ID NO: 93533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttagttggcccttctttc

SEQ ID NO: 93534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttggcccttctttcagca

SEQ ID NO: 93535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttggcccttctttcagcac

SEQ ID NO: 93536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcccttctttcagcacttct

SEQ ID NO: 93537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttcagcacttctattaac

SEQ ID NO: 93538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcagcacttctattaaca

SEQ ID NO: 93539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagcacttctattaacatt

SEQ ID NO: 93540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagcacttctattaacattt

SEQ ID NO: 93541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcacttctattaacatttc

SEQ ID NO: 93542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctattaacatttctctgaaa

SEQ ID NO: 93543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tattaacatttctctgaaat

SEQ ID NO: 93544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaacatttctctgaaatag

SEQ ID NO: 93545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatttctctgaaatagcta

SEQ ID NO: 93546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctgaaatagctatttaga

SEQ ID NO: 93547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgaaatagctatttagaa

SEQ ID NO: 93548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgaaatagctatttagaact

SEQ ID NO: 93549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatagctatttagaactgc

SEQ ID NO: 93550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttagaactgctttatttac

SEQ ID NO: 93551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaactgctttatttacata

SEQ ID NO: 93552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaactgctttatttacatat

SEQ ID NO: 93553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctttatttacatatgcattt

SEQ ID NO: 93554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatttacatatgcattttat

SEQ ID NO: 93555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttacatatgcattttatt

SEQ ID NO: 93556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttacatatgcattttattt

SEQ ID NO: 93557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatatgcattttattttca

SEQ ID NO: 93558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catatgcattttattttcac

SEQ ID NO: 93559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttcactctttttaata

SEQ ID NO: 93560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcactctttttaataa

SEQ ID NO: 93561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcactctttttaataaa

SEQ ID NO: 93562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcactctttttaataaagct

SEQ ID NO: 93563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cactctttttaataaagcta

SEQ ID NO: 93564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actctttttaataaagctat

SEQ ID NO: 93565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttttaataaagctatcaaa

SEQ ID NO: 93566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaataaagctatcaaaac

SEQ ID NO: 93567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaataaagctatcaaaact

SEQ ID NO: 93568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taataaagctatcaaaactc

SEQ ID NO: 93569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataaagctatcaaaactct

SEQ ID NO: 93570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaagctatcaaaactcta

SEQ ID NO: 93571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaaaactctataaaatcat

SEQ ID NO: 93572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tataaaatcatgctaagtat

SEQ ID NO: 93573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaaatcatgctaagtattt

SEQ ID NO: 93574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtattttgggttgtgatgt

SEQ ID NO: 93575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgggttgtgatgttcaacaa

SEQ ID NO: 93576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggttgtgatgttcaacaat

SEQ ID NO: 93577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttgtgatgttcaacaatc

SEQ ID NO: 93578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatgttcaacaatcagcat

SEQ ID NO: 93579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacaatcagcatttaaaaac

SEQ ID NO: 93580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaacagctcacaagtcac

SEQ ID NO: 93581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacagctcacaagtcacc

SEQ ID NO: 93582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaagtcacccaaatctttt

SEQ ID NO: 93583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgcaaactaggtaactatc

SEQ ID NO: 93584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcaaactaggtaactatca

SEQ ID NO: 93585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaaactaggtaactatcaa

SEQ ID NO: 93586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaactaggtaactatcaaa

SEQ ID NO: 93587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtaactatcaaaaagctaa

SEQ ID NO: 93588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaaaaagctaaaattaggt

SEQ ID NO: 93589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaattaggttctctaatttt

SEQ ID NO: 93590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggttctctaattttcatccg

SEQ ID NO: 93591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctaattttcatccgaaaga

SEQ ID NO: 93592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taattttcatccgaaagatt

SEQ ID NO: 93593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttcatccgaaagatttg

SEQ ID NO: 93594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatccgaaagatttgtgtt

SEQ ID NO: 93595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catccgaaagatttgtgttc

SEQ ID NO: 93596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atccgaaagatttgtgttca

SEQ ID NO: 93597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgttcaaacctgtttgggg

SEQ ID NO: 93598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttcaaacctgtttggggc

SEQ ID NO: 93599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacctgtttggggcatggt

SEQ ID NO: 93600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttggggcatggtggctcat

SEQ ID NO: 93601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggcatggtggctcatgcc

SEQ ID NO: 93602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggcatggtggctcatgcct

SEQ ID NO: 93603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgcctgtaaccccagcatg

SEQ ID NO: 93604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaccccagcatgttggcag

SEQ ID NO: 93605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaggtcatgacagtaggaa

SEQ ID NO: 93606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaagccaggagtttgagact

SEQ ID NO: 93607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagccaggagtttgagacta

SEQ ID NO: 93608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagactagcctgggcaacat

SEQ ID NO: 93609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agactagcctgggcaacata

SEQ ID NO: 93610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcctgggcaacatagcaaga

SEQ ID NO: 93611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggcaacatagcaagacccct

SEQ ID NO: 93612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctacaaaaatttaaatat

SEQ ID NO: 93613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctacaaaaatttaaatatt

SEQ ID NO: 93614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaaatttaaatattagcc

SEQ ID NO: 93615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatattagccaggcatggt

SEQ ID NO: 93616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatattagccaggcatggtg

SEQ ID NO: 93617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggcatggtggcatgta

SEQ ID NO: 93618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtcttagctacttgggag

SEQ ID NO: 93619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agctacttgggaggctgagg

SEQ ID NO: 93620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctacttgggaggctgaggc

SEQ ID NO: 93621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttgggaggctgaggcagga

SEQ ID NO: 93622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggaggctgaggcaggaggg

SEQ ID NO: 93623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggaggctgaggcaggagggt

SEQ ID NO: 93624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggcaggagggttgcttgag

SEQ ID NO: 93625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttgagcccagagttgaggc

SEQ ID NO: 93626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagcccagagttgaggctgc

SEQ ID NO: 93627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcccagagttgaggctgca

SEQ ID NO: 93628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggctgcagagagctatgat

SEQ ID NO: 93629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cagagagctatgatcatgcc

SEQ ID NO: 93630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgatcatgccattgcactct

SEQ ID NO: 93631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cactctagcctgggtgacag

SEQ ID NO: 93632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tagcctgggtgacagagcga

SEQ ID NO: 93633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcctgggtgacagagcgaga

SEQ ID NO: 93634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtgacagagcgagacctgg

SEQ ID NO: 93635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtcacttaaaaaagttttta

SEQ ID NO: 93636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaaagtttttagaaaacc

SEQ ID NO: 93637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaagtttttagaaaacct

SEQ ID NO: 93638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagaaaacctgtttgcttc

SEQ ID NO: 93639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagaaaacctgtttgcttcc

SEQ ID NO: 93640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaaaacctgtttgcttcca

SEQ ID NO: 93641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaaacctgtttgcttccat

SEQ ID NO: 93642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttgcttccattttattcta

SEQ ID NO: 93643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttccattttattctaagt

SEQ ID NO: 93644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttccattttattctaagtt

SEQ ID NO: 93645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccattttattctaagttaag

SEQ ID NO: 93646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cattttattctaagttaagt

SEQ ID NO: 93647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattctaagttaagttcttc

SEQ ID NO: 93648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attctaagttaagttcttca

SEQ ID NO: 93649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctaagttaagttcttcag

SEQ ID NO: 93650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagttaagttcttcagtgt

SEQ ID NO: 93651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttaagttcttcagtgtaa

SEQ ID NO: 93652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttcttcagtgtaactgcc

SEQ ID NO: 93653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcagtgtaactgcctttct

SEQ ID NO: 93654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagtgtaactgcctttctgt

SEQ ID NO: 93655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtgtaactgcctttctgta

SEQ ID NO: 93656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctttctgtattgttgggtg

SEQ ID NO: 93657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctgtattgttgggtgtaat

SEQ ID NO: 93658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtattgttgggtgtaata

SEQ ID NO: 93659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtattgttgggtgtaataa

SEQ ID NO: 93660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tattgttgggtgtaataagt

SEQ ID NO: 93661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgggtgtaataagttcagc

SEQ ID NO: 93662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtgtaataagttcagcgat

SEQ ID NO: 93663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcgattataaaatttaaat

SEQ ID NO: 93664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaatttaaatattaatat

SEQ ID NO: 93665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatattaatatgacagtgc

SEQ ID NO: 93666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatattaatatgacagtgcc

SEQ ID NO: 93667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatgacagtgccttctgaa

SEQ ID NO: 93668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgaagggtgaaaccatcag

SEQ ID NO: 93669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgaagggtgaaaccatcagt

SEQ ID NO: 93670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aagggtgaaaccatcagtac

SEQ ID NO: 93671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catggaaagagaggtctaat

SEQ ID NO: 93672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttacttcaagcttatac

SEQ ID NO: 93673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacttcaagcttatacttaa

SEQ ID NO: 93674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttcaagcttatacttaat

SEQ ID NO: 93675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttcaagcttatacttaata

SEQ ID NO: 93676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagcttatacttaataagc

SEQ ID NO: 93677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagcttatacttaataagct

SEQ ID NO: 93678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atacttaataagctctttct

SEQ ID NO: 93679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacttaataagctctttctt

SEQ ID NO: 93680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aataagctctttcttccaaa

SEQ ID NO: 93681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataagctctttcttccaaat

SEQ ID NO: 93682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcttccaaatattatttt

SEQ ID NO: 93683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttccaaatattattttta

SEQ ID NO: 93684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttccaaatattatttttaa

SEQ ID NO: 93685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccaaatattatttttaat

SEQ ID NO: 93686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaaatattatttttaattg

SEQ ID NO: 93687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaatattatttttaattga

SEQ ID NO: 93688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttaattgataaaaagtc

SEQ ID NO: 93689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaattgataaaaagtcaca

SEQ ID NO: 93690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattgataaaaagtcacaa

SEQ ID NO: 93691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattgataaaaagtcacaag

SEQ ID NO: 93692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgataaaaagtcacaagt

SEQ ID NO: 93693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaaaagtcacaagtagac

SEQ ID NO: 93694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgaaacaaacgtaaatata

SEQ ID NO: 93695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaacaaacgtaaatatatat

SEQ ID NO: 93696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaccatgttattttaaaaaa

SEQ ID NO: 93697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accatgttattttaaaaaaa

SEQ ID NO: 93698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttaaaaaaaaacatagtt

SEQ ID NO: 93699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaaaaaaacatagttcat

SEQ ID NO: 93700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaaaaaacatagttcatg

SEQ ID NO: 93701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaaaacatagttcatga

SEQ ID NO: 93702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgaaataggaaaaagaaca

SEQ ID NO: 93703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatatatatttttgaaatgc

SEQ ID NO: 93704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatatatttttgaaatgct

SEQ ID NO: 93705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatatttttgaaatgcta

SEQ ID NO: 93706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaaatgctaagaagaaat

SEQ ID NO: 93707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaaatgctaagaagaaatt

SEQ ID NO: 93708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaatgctaagaagaaattg

SEQ ID NO: 93709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaatgctaagaagaaattgt

SEQ ID NO: 93710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaagaaattgtgttgttaa

SEQ ID NO: 93711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttgttaacaaaccagttg

SEQ ID NO: 93712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttaacaaaccagttgcccat

SEQ ID NO: 93713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acaaaccagttgcccatatt

SEQ ID NO: 93714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccatattttttattttaca

SEQ ID NO: 93715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattttacataaaaacaa

SEQ ID NO: 93716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattttacataaaaacaag

SEQ ID NO: 93717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattttacataaaaacaagg

SEQ ID NO: 93718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttacataaaaacaaggc

SEQ ID NO: 93719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttacataaaaacaaggca

SEQ ID NO: 93720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacataaaaacaaggcaatg

SEQ ID NO: 93721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acataaaaacaaggcaatgt

SEQ ID NO: 93722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cataaaaacaaggcaatgta

SEQ ID NO: 93723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagaaaattacacacgaac

SEQ ID NO: 93724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacacgaacctgtcaaacat

SEQ ID NO: 93725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaaacatcttgtcttacta

SEQ ID NO: 93726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcttactacattatgtaag

SEQ ID NO: 93727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttactacattatgtaagt

SEQ ID NO: 93728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actacattatgtaagtattc

SEQ ID NO: 93729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctacattatgtaagtattca

SEQ ID NO: 93730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattatgtaagtattcataa

SEQ ID NO: 93731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaagtattcataatgcag

SEQ ID NO: 93732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataatgcagttatatttgtg

SEQ ID NO: 93733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttgtgagtttgaaataa

SEQ ID NO: 93734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgagtttgaaataacggta

SEQ ID NO: 93735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgagtttgaaataacggtag

SEQ ID NO: 93736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaataacggtagattgaat

SEQ ID NO: 93737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaataacggtagattgaatt

SEQ ID NO: 93738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aattcaaatttaaggtgatg

SEQ ID NO: 93739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatttaaggtgatgttaaa

SEQ ID NO: 93740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggtgatgttaaattctta

SEQ ID NO: 93741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggtgatgttaaattcttaa

SEQ ID NO: 93742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattcttaattgaatgtatt

SEQ ID NO: 93743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaattgaatgtatttaaaa

SEQ ID NO: 93744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattgaatgtatttaaaaat

SEQ ID NO: 93745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attgaatgtatttaaaaatc

SEQ ID NO: 93746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatgtatttaaaaatctgat

SEQ ID NO: 93747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaatctgataaatgtaat

SEQ ID NO: 93748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatctgataaatgtaata

SEQ ID NO: 93749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ataaatgtaatatattttgt

SEQ ID NO: 93750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtataggtccctacttaaa

SEQ ID NO: 93751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtataggtccctacttaaat

SEQ ID NO: 93752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tataggtccctacttaaatt

SEQ ID NO: 93753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cttaaattatcaaaacctat

SEQ ID NO: 93754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaattatcaaaacctatttc

SEQ ID NO: 93755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattatcaaaacctatttcc

SEQ ID NO: 93756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaaaacctatttccaacag

SEQ ID NO: 93757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttccaacaggcttggtagg

SEQ ID NO: 93758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaacaggcttggtaggtat

SEQ ID NO: 93759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caacaggcttggtaggtatg

SEQ ID NO: 93760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggtaggtatgtgataaaatg

SEQ ID NO: 93761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaggtatgtgataaaatga

SEQ ID NO: 93762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtagtctcggaaaacactg

SEQ ID NO: 93763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggaaaacactgcatggtgtc

SEQ ID NO: 93764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catggtgtctttcatattaa

SEQ ID NO: 93765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcatattaaattaaaaagtg

SEQ ID NO: 93766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catattaaattaaaaagtgg

SEQ ID NO: 93767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atattaaattaaaaagtggt

SEQ ID NO: 93768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattaaaaagtggttcaaat

SEQ ID NO: 93769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaagtggttcaaatagcct

SEQ ID NO: 93770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaatagcctaagatgaatga

SEQ ID NO: 93771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agatgaatgaacctaagatg

SEQ ID NO: 93772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agatggtataaagaatcttt

SEQ ID NO: 93773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagccctagattgagtttta

SEQ ID NO: 93774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agccctagattgagttttat

SEQ ID NO: 93775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccctagattgagttttata

SEQ ID NO: 93776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gattgagttttatacgtaga

SEQ ID NO: 93777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttttatacgtagattagg

SEQ ID NO: 93778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatacgtagattaggacaaa

SEQ ID NO: 93779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atacgtagattaggacaaat

SEQ ID NO: 93780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacgtagattaggacaaatg

SEQ ID NO: 93781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggacaaatgtctcaaagtaa

SEQ ID NO: 93782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagtaataacggatgttgt

SEQ ID NO: 93783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaatatatcacaatttaa

SEQ ID NO: 93784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaaacattctagacttctg

SEQ ID NO: 93785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaacattctagacttctga

SEQ ID NO: 93786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagacttctgatctcattct

SEQ ID NO: 93787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gacttctgatctcattcttt

SEQ ID NO: 93788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgatctcattctttaacca

SEQ ID NO: 93789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatctcattctttaaccat

SEQ ID NO: 93790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atctcattctttaaccataa

SEQ ID NO: 93791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attctttaaccataaatctt

SEQ ID NO: 93792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttaaccataaatctttgtt

SEQ ID NO: 93793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaccataaatctttgtttc

SEQ ID NO: 93794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaccataaatctttgtttct

SEQ ID NO: 93795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
accataaatctttgtttcta

SEQ ID NO: 93796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtttctataggtacgttta

SEQ ID NO: 93797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttctataggtacgtttaa

SEQ ID NO: 93798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttctataggtacgtttaaa

SEQ ID NO: 93799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctataggtacgtttaaatcc

SEQ ID NO: 93800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tataggtacgtttaaatcct

SEQ ID NO: 93801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taggtacgtttaaatcctct

SEQ ID NO: 93802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatcctctttctttttaaa

SEQ ID NO: 93803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatcctctttctttttaaat

SEQ ID NO: 93804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttctttttaaattgccaga

SEQ ID NO: 93805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctttttaaattgccagaac

SEQ ID NO: 93806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctttttaaattgccagaaca

SEQ ID NO: 93807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttttaaattgccagaacaa

SEQ ID NO: 93808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaaattgccagaacaaca

SEQ ID NO: 93809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaattgccagaacaacaa

SEQ ID NO: 93810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaattgccagaacaacaaa

SEQ ID NO: 93811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattgccagaacaacaaaa

SEQ ID NO: 93812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattgccagaacaacaaaaa

SEQ ID NO: 93813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccagaacaacaaaaaatatg

SEQ ID NO: 93814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaacatttattatataaat

SEQ ID NO: 93815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaacatttattatataaatg

SEQ ID NO: 93816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacatttattatataaatgt

SEQ ID NO: 93817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatataaatgtaatttat

SEQ ID NO: 93818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatataaatgtaatttatt

SEQ ID NO: 93819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataaatgtaatttattatt

SEQ ID NO: 93820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attattttttaaatatggaa

SEQ ID NO: 93821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattttttaaatatggaaa

SEQ ID NO: 93822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttttaaatatggaaagca

SEQ ID NO: 93823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaaatatggaaagcaaat

SEQ ID NO: 93824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaaatatggaaagcaaatt

SEQ ID NO: 93825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatatggaaagcaaatta

SEQ ID NO: 93826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatatggaaagcaaattag

SEQ ID NO: 93827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatatggaaagcaaattagt

SEQ ID NO: 93828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgaaagttgttttatatat

SEQ ID NO: 93829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttatatatttgcttcaaa

SEQ ID NO: 93830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatatttgcttcaaaacc

SEQ ID NO: 93831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatatttgcttcaaaacct

SEQ ID NO: 93832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatttgcttcaaaacctc

SEQ ID NO: 93833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttcaaaacctcccacaaa

SEQ ID NO: 93834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttcaaaacctcccacaaaa

SEQ ID NO: 93835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaaacctcccacaaaaatc

SEQ ID NO: 93836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaacctcccacaaaaatct

SEQ ID NO: 93837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccacaaaaatcttctaagta

SEQ ID NO: 93838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaagtaaaactacattcta

SEQ ID NO: 93839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagtaaaactacattctac

SEQ ID NO: 93840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtaaaactacattctacct

SEQ ID NO: 93841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattctacctgtgtagctca

SEQ ID NO: 93842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacctgtgtagctcaatttt

SEQ ID NO: 93843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgtgtagctcaatttttg

SEQ ID NO: 93844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtagctcaatttttgcctg

SEQ ID NO: 93845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatttttgcctgtgcatgaa

SEQ ID NO: 93846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgcctgtgcatgaataact

SEQ ID NO: 93847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcctgtgcatgaataactt

SEQ ID NO: 93848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcctgtgcatgaataacttt

SEQ ID NO: 93849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cctgtgcatgaataacttta

SEQ ID NO: 93850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcatgaataactttataga

SEQ ID NO: 93851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatagaagaaagatctcata

SEQ ID NO: 93852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagaagaaagatctcatat

SEQ ID NO: 93853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagaagaaagatctcatatt

SEQ ID NO: 93854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atattcctgaaataaactca

SEQ ID NO: 93855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgaaataaactcacgaaaa

SEQ ID NO: 93856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaataaactcacgaaaaaaa

SEQ ID NO: 93857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acgaaaaaaagcattatggt

SEQ ID NO: 93858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggttatttcttttcaaatt

SEQ ID NO: 93859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcttttcaaattactatt

SEQ ID NO: 93860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttcaaattactattaat

SEQ ID NO: 93861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttcaaattactattaata

SEQ ID NO: 93862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcaaattactattaatagg

SEQ ID NO: 93863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaattactattaataggt

SEQ ID NO: 93864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaattactattaataggtg

SEQ ID NO: 93865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaattactattaataggtgt

SEQ ID NO: 93866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctattaataggtgttttcaa

SEQ ID NO: 93867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaataggtgttttcaaaaa

SEQ ID NO: 93868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataggtgttttcaaaaaact

SEQ ID NO: 93869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaaaaactagatgtctac

SEQ ID NO: 93870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaaaaactagatgtctaca

SEQ ID NO: 93871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaaaaactagatgtctacag

SEQ ID NO: 93872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gatgtctacagctaatgcaa

SEQ ID NO: 93873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagctaatgcaaaatgaata

SEQ ID NO: 93874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgcaaaatgaatatgtgct

SEQ ID NO: 93875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gataaattagaagcccatgg

SEQ ID NO: 93876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaattagaagcccatggt

SEQ ID NO: 93877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaagcccatggtactgtgtt

SEQ ID NO: 93878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgttgattgaggcaaaatat

SEQ ID NO: 93879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attgaggcaaaatatatttc

SEQ ID NO: 93880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggcaaaatatatttcacat

SEQ ID NO: 93881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacatcatagaattttaagg

SEQ ID NO: 93882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acatcatagaattttaagga

SEQ ID NO: 93883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaggagaaggtgacatctt

SEQ ID NO: 93884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaggagaaggtgacatcttc

SEQ ID NO: 93885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggagaaggtgacatcttcc

SEQ ID NO: 93886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctcattgtatacattgaag

SEQ ID NO: 93887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcattgtatacattgaagt

SEQ ID NO: 93888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgtatacattgaagtata

SEQ ID NO: 93889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatacattgaagtatatcca

SEQ ID NO: 93890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagtatatccaaaaaagatt

SEQ ID NO: 93891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttccataatttaggaaagt

SEQ ID NO: 93892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccataatttaggaaagtaag

SEQ ID NO: 93893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cataatttaggaaagtaagt

SEQ ID NO: 93894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggaaagtaagttggtggca

SEQ ID NO: 93895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaaagtaagttggtggcaa

SEQ ID NO: 93896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtggcaagagagcaagttgg

SEQ ID NO: 93897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaagaatccctatttcaat

SEQ ID NO: 93898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttcaatgcttttttattca

SEQ ID NO: 93899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatgcttttttattcatac

SEQ ID NO: 93900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgcttttttattcatact

SEQ ID NO: 93901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttattcatactaaacaca

SEQ ID NO: 93902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattcatactaaacacat

SEQ ID NO: 93903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattcatactaaacacata

SEQ ID NO: 93904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattcatactaaacacatat

SEQ ID NO: 93905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attcatactaaacacatatc

SEQ ID NO: 93906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcatactaaacacatatct

SEQ ID NO: 93907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atactaaacacatatctgtg

SEQ ID NO: 93908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacacatatctgtgtaaagt

SEQ ID NO: 93909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgtaaagtctgtcatattac

SEQ ID NO: 93910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcatattacatgatttgaaa

SEQ ID NO: 93911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgatttgaaagcttgcca

SEQ ID NO: 93912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaagcttgccaaacacggg

SEQ ID NO: 93913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagcttgccaaacacggga

SEQ ID NO: 93914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gccaaacacgggattgtata

SEQ ID NO: 93915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaaacacgggattgtatac

SEQ ID NO: 93916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatacaagtgatgcaataaa

SEQ ID NO: 93917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcccaagttattatctgct

SEQ ID NO: 93918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatctgctcaagtatgtac

SEQ ID NO: 93919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgctcaagtatgtaccgt

SEQ ID NO: 93920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcaagtatgtaccgtggtc

SEQ ID NO: 93921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagtatgtaccgtggtcaaa

SEQ ID NO: 93922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
actgcatatcaggaaggatt

SEQ ID NO: 93923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catatcaggaaggatttcat

SEQ ID NO: 93924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catcaactttgcttacagcg

SEQ ID NO: 93925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atcaactttgcttacagcga

SEQ ID NO: 93926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcttacagcgaaaggatga

SEQ ID NO: 93927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcttacagcgaaaggatgac

SEQ ID NO: 93928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cttacagcgaaaggatgact

SEQ ID NO: 93929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acagcgaaaggatgactaaa

SEQ ID NO: 93930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagcgaaaggatgactaaac

SEQ ID NO: 93931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacaatactgcataagaaag

SEQ ID NO: 93932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cataagaaagcaggaaaatt

SEQ ID NO: 93933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacaaaagagtttaagagac

SEQ ID NO: 93934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaaaagagtttaagagact

SEQ ID NO: 93935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagagactattatcagtatt

SEQ ID NO: 93936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agagactattatcagtattt

SEQ ID NO: 93937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatcagtattttgggcagc

SEQ ID NO: 93938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcagtattttgggcagcaca

SEQ ID NO: 93939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgggcagcacagtcaaatgt

SEQ ID NO: 93940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggcagcacagtcaaatgtt

SEQ ID NO: 93941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggcagcacagtcaaatgtta

SEQ ID NO: 93942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggctatgtaaataatagcaa

SEQ ID NO: 93943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtaaataatagcaaataga

SEQ ID NO: 93944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtcaataacttttttctc

SEQ ID NO: 93945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtcaataacttttttctca

SEQ ID NO: 93946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaataacttttttctcagt

SEQ ID NO: 93947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttctcagttatctttgtt

SEQ ID NO: 93948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctcagttatctttgttt

SEQ ID NO: 93949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctcagttatctttgtttt

SEQ ID NO: 93950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcagttatctttgttttt

SEQ ID NO: 93951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcagttatctttgtttttt

SEQ ID NO: 93952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcagttatctttgttttttt

SEQ ID NO: 93953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agttatctttgttttttttg

SEQ ID NO: 93954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctttgttttttttgaggag

SEQ ID NO: 93955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttttttttgaggagtgta

SEQ ID NO: 93956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttttttgaggagtgtaa

SEQ ID NO: 93957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttttttgaggagtgtaat

SEQ ID NO: 93958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttgaggagtgtaatatg

SEQ ID NO: 93959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgaggagtgtaatatgt

SEQ ID NO: 93960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgaggagtgtaatatgta

SEQ ID NO: 93961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgaggagtgtaatatgtac

SEQ ID NO: 93962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaggagtgtaatatgtact

SEQ ID NO: 93963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaggagtgtaatatgtactt

SEQ ID NO: 93964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggagtgtaatatgtactta

SEQ ID NO: 93965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agaataatttttcaagttct

SEQ ID NO: 93966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaataatttttcaagttctg

SEQ ID NO: 93967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaagttctgtggttattc

SEQ ID NO: 93968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaagttctgtggttattct

SEQ ID NO: 93969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagttctgtggttattcta

SEQ ID NO: 93970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagttctgtggttattctat

SEQ ID NO: 93971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtggttattctatgaacaa

SEQ ID NO: 93972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tggttattctatgaacaaaa

SEQ ID NO: 93973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctatgaacaaaaagggat

SEQ ID NO: 93974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatgaacaaaaagggatatg

SEQ ID NO: 93975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaacaaaaagggatatgaa

SEQ ID NO: 93976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgaaacacaatactctaaag

SEQ ID NO: 93977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaaggtaagtcttatcctt

SEQ ID NO: 93978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaggtaagtcttatccttgt

SEQ ID NO: 93979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atccttgttggcatgtgagt

SEQ ID NO: 93980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccttgttggcatgtgagtc

SEQ ID NO: 93981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttggcatgtgagtcaagat

SEQ ID NO: 93982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttggcatgtgagtcaagatg

SEQ ID NO: 93983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatgtgagtcaagatgaat

SEQ ID NO: 93984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagaaatgaatagcctaca

SEQ ID NO: 93985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagaaatgaatagcctacat

SEQ ID NO: 93986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catatatttttaatcccatg

SEQ ID NO: 93987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaatcccatggcattttat

SEQ ID NO: 93988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatcccatggcattttata

SEQ ID NO: 93989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatcccatggcattttatag

SEQ ID NO: 93990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcccatggcattttatagg

SEQ ID NO: 93991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataggcacatataaattgg

SEQ ID NO: 93992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataggcacatataaattggt

SEQ ID NO: 93993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taggcacatataaattggtt

SEQ ID NO: 93994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttctgatgcaatgtagaat

SEQ ID NO: 93995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatgcaatgtagaataaat

SEQ ID NO: 93996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atgcaatgtagaataaattt

SEQ ID NO: 93997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagcacctcaaaatatagaa

SEQ ID NO: 93998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcacctcaaaatatagaat

SEQ ID NO: 93999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaatatagaataacctctg

SEQ ID NO: 94000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtacattgataaaaagtca

SEQ ID NO: 94001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tacattgataaaaagtcaag

SEQ ID NO: 94002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaaaagtcaagctcccta

SEQ ID NO: 94003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctaataatgcattttaact

SEQ ID NO: 94004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ataatgcattttaactaaac

SEQ ID NO: 94005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taactaaacattcataacta

SEQ ID NO: 94006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactaaacattcataactaa

SEQ ID NO: 94007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actaaacattcataactaat

SEQ ID NO: 94008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacattcataactaatgtcc

SEQ ID NO: 94009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataactaatgtccattactt

SEQ ID NO: 94010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgtccattacttctatcaa

SEQ ID NO: 94011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttctatcaagcatttcatt

SEQ ID NO: 94012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctatcaagcatttcattgca

SEQ ID NO: 94013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatcaagcatttcattgcaa

SEQ ID NO: 94014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcaagcatttcattgcaaag

SEQ ID NO: 94015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattgcaaagccaaggcaaa

SEQ ID NO: 94016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgcaaagccaaggcaaat

SEQ ID NO: 94017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaagccaaggcaaatactt

SEQ ID NO: 94018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgttgatttccaaataata

SEQ ID NO: 94019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttgatttccaaataatag

SEQ ID NO: 94020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgatttccaaataataga

SEQ ID NO: 94021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgatttccaaataatagat

SEQ ID NO: 94022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttccaaataatagataaa

SEQ ID NO: 94023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaataatagataaataat

SEQ ID NO: 94024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaataatagataaataata

SEQ ID NO: 94025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgtatgcgtgtgttgtt

SEQ ID NO: 94026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtatgcgtgtgttgttt

SEQ ID NO: 94027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtatgcgtgtgttgttta

SEQ ID NO: 94028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtatgcgtgtgttgtttat

SEQ ID NO: 94029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgcgtgtgttgtttattt

SEQ ID NO: 94030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttatttacatgggaaacaa

SEQ ID NO: 94031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttacatgggaaacaagac

SEQ ID NO: 94032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttacatgggaaacaagact

SEQ ID NO: 94033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acatgggaaacaagactaat

SEQ ID NO: 94034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catgggaaacaagactaatt

SEQ ID NO: 94035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attacaatcctgtgaaaaga

SEQ ID NO: 94036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caatcctgtgaaaagatgac

SEQ ID NO: 94037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaaaagatgacaaggcaga

SEQ ID NO: 94038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctacatggtcttctgattt

SEQ ID NO: 94039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctacatggtcttctgattta

SEQ ID NO: 94040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacatggtcttctgatttat

SEQ ID NO: 94041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catggtcttctgatttatta

SEQ ID NO: 94042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgatttattaaaaaccaaa

SEQ ID NO: 94043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgatttattaaaaaccaaaa

SEQ ID NO: 94044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atttattaaaaaccaaaaaa

SEQ ID NO: 94045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaaaaaccaaaaaactga

SEQ ID NO: 94046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaaaaaccaaaaaactgaa

SEQ ID NO: 94047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaccaaaaaactgaatca

SEQ ID NO: 94048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatcacttttgtatgctata

SEQ ID NO: 94049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtatgctataatcaataa

SEQ ID NO: 94050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtatgctataatcaataat

SEQ ID NO: 94051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatgctataatcaataatt

SEQ ID NO: 94052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatgctataatcaataattc

SEQ ID NO: 94053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatcaataattcctacaga

SEQ ID NO: 94054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctacagagttctcttacgat

SEQ ID NO: 94055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagagttctcttacgattct

SEQ ID NO: 94056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttacgattcttaaagaat

SEQ ID NO: 94057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttacgattcttaaagaatca

SEQ ID NO: 94058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acgattcttaaagaatcatc

SEQ ID NO: 94059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cgattcttaaagaatcatca

SEQ ID NO: 94060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaaagaatcatcagtgcaa

SEQ ID NO: 94061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagaatcatcagtgcaaaa

SEQ ID NO: 94062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagaatcatcagtgcaaaaa

SEQ ID NO: 94063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaatgctgcccacctttct

SEQ ID NO: 94064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgctgcccacctttcttag

SEQ ID NO: 94065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccacctttcttaggaaatc

SEQ ID NO: 94066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttaggaaatcagagttag

SEQ ID NO: 94067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaggaaatcagagttagt

SEQ ID NO: 94068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaggaaatcagagttagtg

SEQ ID NO: 94069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggaaatcagagttagtgac

SEQ ID NO: 94070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggaaatcagagttagtgact

SEQ ID NO: 94071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgactgcactgccttcgag

SEQ ID NO: 94072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cactgccttcgagaatattt

SEQ ID NO: 94073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ccttcgagaatattttgata

SEQ ID NO: 94074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cgagaatattttgataaaaa

SEQ ID NO: 94075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gagaatattttgataaaaag

SEQ ID NO: 94076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgataaaaaggattttggca

SEQ ID NO: 94077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gataaaaaggattttggcat

SEQ ID NO: 94078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataaaaaggattttggcata

SEQ ID NO: 94079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggcatagacttcctcaaaa

SEQ ID NO: 94080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcatagacttcctcaaaag

SEQ ID NO: 94081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcatagacttcctcaaaaga

SEQ ID NO: 94082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctcaaaagagttttattaa

SEQ ID NO: 94083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaaaagagttttattaac

SEQ ID NO: 94084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaagagttttattaacaca

SEQ ID NO: 94085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattaacacaaataaatcac

SEQ ID NO: 94086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attaacacaaataaatcact

SEQ ID NO: 94087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaacacaaataaatcactt

SEQ ID NO: 94088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acacaaataaatcactttca

SEQ ID NO: 94089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcacaggctgtaaacaatat

SEQ ID NO: 94090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacaggctgtaaacaatata

SEQ ID NO: 94091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaggctgtaaacaatatat

SEQ ID NO: 94092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaacaatatatcaaaaatg

SEQ ID NO: 94093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tattttttgctttccttgct

SEQ ID NO: 94094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttttgctttccttgctgt

SEQ ID NO: 94095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgctttccttgctgtctt

SEQ ID NO: 94096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgctttccttgctgtcttt

SEQ ID NO: 94097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctttccttgctgtctttc

SEQ ID NO: 94098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttccttgctgtctttcc

SEQ ID NO: 94099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttccttgctgtctttccc

SEQ ID NO: 94100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccttgctgtctttcccttt

SEQ ID NO: 94101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttgctgtctttccctttg

SEQ ID NO: 94102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgctgtctttccctttgt

SEQ ID NO: 94103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctgtctttccctttgtctt

SEQ ID NO: 94104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctgtctttccctttgtcttc

SEQ ID NO: 94105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctttccctttgtcttcctt

SEQ ID NO: 94106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccctttgtcttccttttct

SEQ ID NO: 94107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctttgtcttccttttctg

SEQ ID NO: 94108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttgtcttccttttctgt

SEQ ID NO: 94109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtcttccttttctgttctg

SEQ ID NO: 94110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcttccttttctgttctgt

SEQ ID NO: 94111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcttccttttctgttctgtc

SEQ ID NO: 94112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttttctgttctgtcttgt

SEQ ID NO: 94113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttttctgttctgtcttgtt

SEQ ID NO: 94114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctgttctgtcttgttcat

SEQ ID NO: 94115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgttctgtcttgttcata

SEQ ID NO: 94116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgttctgtcttgttcatat

SEQ ID NO: 94117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttctgtcttgttcatatt

SEQ ID NO: 94118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttctgtcttgttcatatttc

SEQ ID NO: 94119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtcttgttcatatttctct

SEQ ID NO: 94120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttgttcatatttctcttt

SEQ ID NO: 94121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttcatatttctctttgtct

SEQ ID NO: 94122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttcatatttctctttgtctg

SEQ ID NO: 94123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatttctctttgtctggct

SEQ ID NO: 94124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctctttgtctggctttgtta

SEQ ID NO: 94125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttgtctggctttgttac

SEQ ID NO: 94126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgtctggctttgttacac

SEQ ID NO: 94127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtctggctttgttacacta

SEQ ID NO: 94128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctggctttgttacactat

SEQ ID NO: 94129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctggctttgttacactatc

SEQ ID NO: 94130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctttgttacactatcatat

SEQ ID NO: 94131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttacactatcatatgaag

SEQ ID NO: 94132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttacactatcatatgaagg

SEQ ID NO: 94133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttacactatcatatgaaggt

SEQ ID NO: 94134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactatcatatgaaggtgga

SEQ ID NO: 94135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcatatgaaggtggagaggt

SEQ ID NO: 94136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttttctggacttgagttc

SEQ ID NO: 94137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttctggacttgagttctca

SEQ ID NO: 94138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctggacttgagttctcat

SEQ ID NO: 94139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctggacttgagttctcatt

SEQ ID NO: 94140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctggacttgagttctcatta

SEQ ID NO: 94141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggacttgagttctcattaa

SEQ ID NO: 94142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gacttgagttctcattaaca

SEQ ID NO: 94143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagttctcattaacattatc

SEQ ID NO: 94144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agttctcattaacattatca

SEQ ID NO: 94145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcattaacattatcaaaagc

SEQ ID NO: 94146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attaacattatcaaaagcca

SEQ ID NO: 94147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acattatcaaaagccatatc

SEQ ID NO: 94148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaaaagccatatctttttt

SEQ ID NO: 94149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttattgagtaaatcatca

SEQ ID NO: 94150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttattgagtaaatcatcat

SEQ ID NO: 94151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattgagtaaatcatcatc

SEQ ID NO: 94152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgagtaaatcatcatct

SEQ ID NO: 94153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgagtaaatcatcatctc

SEQ ID NO: 94154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgagtaaatcatcatctct

SEQ ID NO: 94155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtaaatcatcatctctgtc

SEQ ID NO: 94156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtctccatcttttatgtat

SEQ ID NO: 94157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tctccatcttttatgtatat

SEQ ID NO: 94158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catcttttatgtatatactt

SEQ ID NO: 94159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatgtatatacttgatata

SEQ ID NO: 94160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgtatatacttgatatat

SEQ ID NO: 94161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtatatacttgatatatt

SEQ ID NO: 94162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtatatacttgatatattt

SEQ ID NO: 94163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatatatttttgacattttg

SEQ ID NO: 94164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atatatttttgacattttgc

SEQ ID NO: 94165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgacattttgccttaagcg

SEQ ID NO: 94166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgacattttgccttaagcgg

SEQ ID NO: 94167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacattttgccttaagcggt

SEQ ID NO: 94168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acattttgccttaagcggta

SEQ ID NO: 94169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgccttaagcggtaacgtct

SEQ ID NO: 94170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gccttaagcggtaacgtcta

SEQ ID NO: 94171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccttaagcggtaacgtctat

SEQ ID NO: 94172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagcggtaacgtctataagc

SEQ ID NO: 94173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agcggtaacgtctataagca

SEQ ID NO: 94174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taagcacgctgaatgacagt

SEQ ID NO: 94175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgacagtagcagacacat

SEQ ID NO: 94176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgtttccgttttagtgtgg

SEQ ID NO: 94177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtttccgttttagtgtggtt

SEQ ID NO: 94178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttccgttttagtgtggttg

SEQ ID NO: 94179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccgttttagtgtggttgtga

SEQ ID NO: 94180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cgttttagtgtggttgtgat

SEQ ID NO: 94181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtgtggttgtgatgggtt

SEQ ID NO: 94182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtgtggttgtgatgggttc

SEQ ID NO: 94183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgtggttgtgatgggttca

SEQ ID NO: 94184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgatgggttcataggacact

SEQ ID NO: 94185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataggacactttggaaggat

SEQ ID NO: 94186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggaaggatttgcagacatg

SEQ ID NO: 94187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaaggatttgcagacatga

SEQ ID NO: 94188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaggatttgcagacatgaa

SEQ ID NO: 94189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagacatgaacctttcttc

SEQ ID NO: 94190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagacatgaacctttcttcc

SEQ ID NO: 94191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttccatctgtgaacgaag

SEQ ID NO: 94192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttccatctgtgaacgaaga

SEQ ID NO: 94193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccatctgtgaacgaagag

SEQ ID NO: 94194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccatctgtgaacgaagagaa

SEQ ID NO: 94195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catctgtgaacgaagagaat

SEQ ID NO: 94196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgaacgaagagaatccatct

SEQ ID NO: 94197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cccactctcacccaaaacac

SEQ ID NO: 94198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcacccaaaacacgctttgt

SEQ ID NO: 94199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acccaaaacacgctttgtaa

SEQ ID NO: 94200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtaaaagcaaataagatgt

SEQ ID NO: 94201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaaaagcaaataagatgtc

SEQ ID NO: 94202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaaagcaaataagatgtca

SEQ ID NO: 94203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
accatgggcagatccatggc

SEQ ID NO: 94204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gactttgttgggttttgcta

SEQ ID NO: 94205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttgggttttgctatgaga

SEQ ID NO: 94206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttgggttttgctatgagaa

SEQ ID NO: 94207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttgggttttgctatgagaag

SEQ ID NO: 94208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggttttgctatgagaagagg

SEQ ID NO: 94209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctatgagaagaggaggat

SEQ ID NO: 94210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctatgagaagaggaggatc

SEQ ID NO: 94211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctatgagaagaggaggatcc

SEQ ID NO: 94212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgagaagaggaggatccagg

SEQ ID NO: 94213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaaatcagagagtttagag

SEQ ID NO: 94214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agagaactctataaactggg

SEQ ID NO: 94215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gagaactctataaactgggt

SEQ ID NO: 94216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tataaactgggtcgcatcgg

SEQ ID NO: 94217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaactgggtcgcatcggga

SEQ ID NO: 94218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtcgcatcgggatcaaact

SEQ ID NO: 94219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcccaaacctcatagaaca

SEQ ID NO: 94220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcccaaacctcatagaacat

SEQ ID NO: 94221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaacctcatagaacatct

SEQ ID NO: 94222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atagaacatctcaaagtcat

SEQ ID NO: 94223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaagtcatcctcactcagag

SEQ ID NO: 94224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcagaggttcagtacttt

SEQ ID NO: 94225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaggttcagtactttcttc

SEQ ID NO: 94226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtactttcttcagtggcaa

SEQ ID NO: 94227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttcagtggcaacactaaa

SEQ ID NO: 94228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcagtggcaacactaaaa

SEQ ID NO: 94229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcagtggcaacactaaaat

SEQ ID NO: 94230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagtggcaacactaaaattc

SEQ ID NO: 94231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtggcaacactaaaattct

SEQ ID NO: 94232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaattctccagtatgactgc

SEQ ID NO: 94233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccagtatgactgcaatgta

SEQ ID NO: 94234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagtatgactgcaatgtaca

SEQ ID NO: 94235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caatgtacatgttcaccaca

SEQ ID NO: 94236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accacaaccaggaaggatat

SEQ ID NO: 94237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acaaagtagaatattccaac

SEQ ID NO: 94238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caacagatgggttaccacag

SEQ ID NO: 94239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccacagtctccttcaactga

SEQ ID NO: 94240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttcaactgaacttccagga

SEQ ID NO: 94241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caactgaacttccaggatga

SEQ ID NO: 94242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aactgaacttccaggatgaa

SEQ ID NO: 94243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacttccaggatgaactttt

SEQ ID NO: 94244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccaggatgaactttttttgg

SEQ ID NO: 94245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caggatgaactttttttggg

SEQ ID NO: 94246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttgggtcacagtcgggt

SEQ ID NO: 94247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgggtcacagtcgggtg

SEQ ID NO: 94248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgggtcacagtcgggtgg

SEQ ID NO: 94249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgggtcacagtcgggtggc

SEQ ID NO: 94250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgggtcacagtcgggtggct

SEQ ID NO: 94251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggtcacagtcgggtggctt

SEQ ID NO: 94252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtcacagtcgggtggctta

SEQ ID NO: 94253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actgttaagaataggtgcta

SEQ ID NO: 94254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgttaagaataggtgctag

SEQ ID NO: 94255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttaagaataggtgctagcaa

SEQ ID NO: 94256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaataggtgctagcaatcc

SEQ ID NO: 94257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcaatccatcccagccagca

SEQ ID NO: 94258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatttggaacaggcaaatc

SEQ ID NO: 94259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggaacaggcaaatcatactg

SEQ ID NO: 94260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaacaggcaaatcatactgt

SEQ ID NO: 94261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgccaaaggtctcaaaatt

SEQ ID NO: 94262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ccaaaggtctcaaaattgaa

SEQ ID NO: 94263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaattgaacatgtcattaa

SEQ ID NO: 94264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacatgtcattaattccatc

SEQ ID NO: 94265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attccatcttcctttttaac

SEQ ID NO: 94266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcttcctttttaacatag

SEQ ID NO: 94267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctttttaacataggcaaag

SEQ ID NO: 94268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttttaacataggcaaagt

SEQ ID NO: 94269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaacataggcaaagttgg

SEQ ID NO: 94270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaacataggcaaagttgga

SEQ ID NO: 94271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacataggcaaagttggac

SEQ ID NO: 94272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacataggcaaagttggaca

SEQ ID NO: 94273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acataggcaaagttggacat

SEQ ID NO: 94274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gacattccaaagatggcgta

SEQ ID NO: 94275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaagatggcgtagatgaac

SEQ ID NO: 94276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacaacgcaggaagggacat

SEQ ID NO: 94277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgctcctttgactagacgta

SEQ ID NO: 94278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctcctttgactagacgtag

SEQ ID NO: 94279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctcctttgactagacgtagg

SEQ ID NO: 94280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttgactagacgtaggatt

SEQ ID NO: 94281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgactagacgtaggattcgg

SEQ ID NO: 94282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactagacgtaggattcggc

SEQ ID NO: 94283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actagacgtaggattcggcc

SEQ ID NO: 94284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gacgtaggattcggccaatc

SEQ ID NO: 94285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ggccaatcctggcaagacgg

SEQ ID NO: 94286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcaagacggatcactcggaa

SEQ ID NO: 94287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggaacagggtaggggacaca

SEQ ID NO: 94288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatcaaatcagctagaaac

SEQ ID NO: 94289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatcaaatcagctagaaaca

SEQ ID NO: 94290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaacatacctgtatgtgga

SEQ ID NO: 94291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tatgtggaggaaaataatag

SEQ ID NO: 94292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagatgtatgctacctgaa

SEQ ID NO: 94293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagatgtatgctacctgaaa

SEQ ID NO: 94294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgaaatgatgactctaaa

SEQ ID NO: 94295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatgatgactctaaacagt

SEQ ID NO: 94296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taaacagttttatctgtcaa

SEQ ID NO: 94297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aacagttttatctgtcaact

SEQ ID NO: 94298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctgtcaactcatttctt

SEQ ID NO: 94299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgtcaactcatttctta

SEQ ID NO: 94300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgtcaactcatttcttat

SEQ ID NO: 94301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcaactcatttcttatgaat

SEQ ID NO: 94302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atttcttatgaattcaagac

SEQ ID NO: 94303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatgaattcaagacagtt

SEQ ID NO: 94304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatgaattcaagacagttt

SEQ ID NO: 94305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atgaattcaagacagttttt

SEQ ID NO: 94306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgaattcaagacagtttttt

SEQ ID NO: 94307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagacagttttttttttttt

SEQ ID NO: 94308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttt

SEQ ID NO: 94326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttttg

SEQ ID NO: 94327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttttttttga

SEQ ID NO: 94328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttttgag

SEQ ID NO: 94329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttttttgaga

SEQ ID NO: 94330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttttgagac

SEQ ID NO: 94331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttttgagacg

SEQ ID NO: 94332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttttgagacgg

SEQ ID NO: 94333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttttgagacgga

SEQ ID NO: 94334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttttgagacggag

SEQ ID NO: 94335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttttgagacggagt

SEQ ID NO: 94336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttttgagacggagtc

SEQ ID NO: 94337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttgagacggagtct

SEQ ID NO: 94338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttgagacggagtctc

SEQ ID NO: 94339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttgagacggagtctcg

SEQ ID NO: 94340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttgagacggagtctcgc

SEQ ID NO: 94341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgagacggagtctcgct

SEQ ID NO: 94342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgagacggagtctcgctc

SEQ ID NO: 94343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgagacggagtctcgctct

SEQ ID NO: 94344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagacggagtctcgctctg

SEQ ID NO: 94345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagacggagtctcgctctgt

SEQ ID NO: 94346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agacggagtctcgctctgtc

SEQ ID NO: 94347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gctctgtcgcccaggctgga

SEQ ID NO: 94348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtcgcccaggctggagtgc

SEQ ID NO: 94349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcgcccaggctggagtgcag

SEQ ID NO: 94350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtgcagtggcgcgatctc

SEQ ID NO: 94351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggctcactgcaagctccgcc

SEQ ID NO: 94352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actgcaagctccgcctcccg

SEQ ID NO: 94353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caagctccgcctcccgggtt

SEQ ID NO: 94354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cgcctcccgggttcacgcca

SEQ ID NO: 94355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccgggttcacgccattctcc

SEQ ID NO: 94356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acgccattctcctgcctcag

SEQ ID NO: 94357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctgcctcagcctcccgag

SEQ ID NO: 94358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgcctcagcctcccgagta

SEQ ID NO: 94359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cctcagcctcccgagtagct

SEQ ID NO: 94360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctcccgagtagctggga

SEQ ID NO: 94361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccgagtagctgggactacag

SEQ ID NO: 94362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggactacaggcgcccgctac

SEQ ID NO: 94363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caggcgcccgctaccacgcc

SEQ ID NO: 94364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccacgcccggctaatttttt

SEQ ID NO: 94365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttttgtatttttagtag

SEQ ID NO: 94366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtatttttagtagagac

SEQ ID NO: 94367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtatttttagtagagacg

SEQ ID NO: 94368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtatttttagtagagacgg

SEQ ID NO: 94369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatttttagtagagacggg

SEQ ID NO: 94370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatttttagtagagacgggg

SEQ ID NO: 94371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagtagagacggggtttca

SEQ ID NO: 94372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagtagagacggggtttcac

SEQ ID NO: 94373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agtagagacggggtttcacc

SEQ ID NO: 94374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtagagacggggtttcacct

SEQ ID NO: 94375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccttgttagccaggatgg

SEQ ID NO: 94376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accttgttagccaggatggt

SEQ ID NO: 94377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttagccaggatggtctcga

SEQ ID NO: 94378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttagccaggatggtctcgat

SEQ ID NO: 94379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gccaggatggtctcgatctc

SEQ ID NO: 94380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gatctcctgacctcgtgatc

SEQ ID NO: 94381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctgacctcgtgatccgcccg

SEQ ID NO: 94382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acctcgtgatccgcccgcct

SEQ ID NO: 94383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
gtgatccgcccgcctcggcc

SEQ ID NO: 94384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggcctcccaaagtgctggga

SEQ ID NO: 94385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaaagtgctgggattacag

SEQ ID NO: 94386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggattacaggcgtgagccac

SEQ ID NO: 94387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caggcgtgagccaccgtgcc

SEQ ID NO: 94388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttatactgaatgcaatta

SEQ ID NO: 94389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatactgaatgcaattactt

SEQ ID NO: 94390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atactgaatgcaattactta

SEQ ID NO: 94391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactgaatgcaattacttaa

SEQ ID NO: 94392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aatgcaattacttaaaaaag

SEQ ID NO: 94393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaaaaaaggattaagaaa

SEQ ID NO: 94394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaaaaggattaagaaattc

SEQ ID NO: 94395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaaaggattaagaaattcc

SEQ ID NO: 94396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaaattccaaagagaaatg

SEQ ID NO: 94397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaagagaaatgactaacat

SEQ ID NO: 94398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
acattaccattgtgacattt

SEQ ID NO: 94399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccattgtgacattttctcct

SEQ ID NO: 94400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgacattttctcctttttac

SEQ ID NO: 94401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctcctttttactaagttca

SEQ ID NO: 94402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcctttttactaagttcat

SEQ ID NO: 94403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctttttactaagttcatg

SEQ ID NO: 94404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctttttactaagttcatggg

SEQ ID NO: 94405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttactaagttcatgggcca

SEQ ID NO: 94406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttactaagttcatgggccat

SEQ ID NO: 94407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactaagttcatgggccatt

SEQ ID NO: 94408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actaagttcatgggccattt

SEQ ID NO: 94409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaagttcatgggccatttt

SEQ ID NO: 94410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agttcatgggccattttttc

SEQ ID NO: 94411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgggccattttttccctcc

SEQ ID NO: 94412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccctccataatagtgtt

SEQ ID NO: 94413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccctccataatagtgttt

SEQ ID NO: 94414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccctccataatagtgtttt

SEQ ID NO: 94415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctccataatagtgtttta

SEQ ID NO: 94416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctccataatagtgttttac

SEQ ID NO: 94417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cataatagtgttttacattt

SEQ ID NO: 94418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacattttaagaatgatacc

SEQ ID NO: 94419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acattttaagaatgatacct

SEQ ID NO: 94420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cattttaagaatgataccta

SEQ ID NO: 94421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagaatgatacctactcac

SEQ ID NO: 94422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagaatgatacctactcaca

SEQ ID NO: 94423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaatgatacctactcacat

SEQ ID NO: 94424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctcacatagaaaattcaagc

SEQ ID NO: 94425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acatagaaaattcaagcaat

SEQ ID NO: 94426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagcaataccgttaaatgct

SEQ ID NO: 94427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgctaaaaagaaaatata

SEQ ID NO: 94428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagaaaatataaatcacc

SEQ ID NO: 94429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatgtcaacaataactatt

SEQ ID NO: 94430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttatcaatatttttttgagt

SEQ ID NO: 94431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaatatttttttgagtatc

SEQ ID NO: 94432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgagtatcacttcagac

SEQ ID NO: 94433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgagtatcacttcagaca

SEQ ID NO: 94434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgagtatcacttcagacat

SEQ ID NO: 94435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgagtatcacttcagacatt

SEQ ID NO: 94436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gagtatcacttcagacattt

SEQ ID NO: 94437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtatcacttcagacatttt

SEQ ID NO: 94438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagacatttttctgtgcaag

SEQ ID NO: 94439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agacatttttctgtgcaagc

SEQ ID NO: 94440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttctgtgcaagcacatgtac

SEQ ID NO: 94441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctgtgcaagcacatgtaca

SEQ ID NO: 94442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctgtgcaagcacatgtacac

SEQ ID NO: 94443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtgcaagcacatgtacaca

SEQ ID NO: 94444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgcaagcacatgtacacaca

SEQ ID NO: 94445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgttatataagcttttttt

SEQ ID NO: 94446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tataagctttttttgtaacc

SEQ ID NO: 94447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttgtaacctatttattt

SEQ ID NO: 94448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgtaacctatttattta

SEQ ID NO: 94449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtaacctatttatttat

SEQ ID NO: 94450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtaacctatttatttatt

SEQ ID NO: 94451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtaacctatttatttattt

SEQ ID NO: 94452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaacctatttatttatttt

SEQ ID NO: 94453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taacctatttatttattttt

SEQ ID NO: 94454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttatttatttttcaagaca

SEQ ID NO: 94455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatttttcaagacagag

SEQ ID NO: 94456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatttttcaagacagagt

SEQ ID NO: 94457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttcaagacagagtctt

SEQ ID NO: 94458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttcaagacagagtcttg

SEQ ID NO: 94459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcaagacagagtcttgctc

SEQ ID NO: 94460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaagacagagtcttgctct

SEQ ID NO: 94461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagacagagtcttgctctg

SEQ ID NO: 94462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagacagagtcttgctctgt

SEQ ID NO: 94463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gctctgtcgccaaagctgga

SEQ ID NO: 94464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctctgtcgccaaagctggag

SEQ ID NO: 94465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgtcgccaaagctggagtgc

SEQ ID NO: 94466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcgccaaagctggagtgcgg

SEQ ID NO: 94467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gagtgcggtggtgtgatctt

SEQ ID NO: 94468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggcctactgcaatctctgca

SEQ ID NO: 94469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcctactgcaatctctgcat

SEQ ID NO: 94470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctgcaatctctgcatcccgg

SEQ ID NO: 94471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caatctctgcatcccgggat

SEQ ID NO: 94472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcatcccgggatcaaatga

SEQ ID NO: 94473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catcccgggatcaaatgatt

SEQ ID NO: 94474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccagcctcagcctccagag

SEQ ID NO: 94475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagcctcagcctccagagta

SEQ ID NO: 94476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcctccagagtagctggga

SEQ ID NO: 94477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagagtagctgggactacag

SEQ ID NO: 94478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggactacaggcatgcgccac

SEQ ID NO: 94479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caggcatgcgccaccacacc

SEQ ID NO: 94480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttaatttttgtgtttttgg

SEQ ID NO: 94481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttttgtgtttttggtagg

SEQ ID NO: 94482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgtttttggtagggacg

SEQ ID NO: 94483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgtttttggtagggacgg

SEQ ID NO: 94484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgtttttggtagggacggt

SEQ ID NO: 94485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgtttttggtagggacggtt

SEQ ID NO: 94486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggtagggacggttttcac

SEQ ID NO: 94487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtagggacggttttcacc

SEQ ID NO: 94488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtagggacggttttcacct

SEQ ID NO: 94489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtagggacggttttcacctt

SEQ ID NO: 94490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaccttgttggccaggctg

SEQ ID NO: 94491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caccttgttggccaggctgg

SEQ ID NO: 94492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
accttgttggccaggctggt

SEQ ID NO: 94493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gttggccaggctggtctcaa

SEQ ID NO: 94494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttggccaggctggtctcaaa

SEQ ID NO: 94495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccaggctggtctcaaactt

SEQ ID NO: 94496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtctcaaacttctgacttca

SEQ ID NO: 94497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaacttctgacttcaagtga

SEQ ID NO: 94498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgacttcaagtgatttcgc

SEQ ID NO: 94499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgacttcaagtgatttcgcc

SEQ ID NO: 94500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttcaagtgatttcgccca

SEQ ID NO: 94501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caagtgatttcgcccacctc

SEQ ID NO: 94502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtgatttcgcccacctcg

SEQ ID NO: 94503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cgcccacctcggcctcccaa

SEQ ID NO: 94504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
gcccacctcggcctcccaat

SEQ ID NO: 94505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggcctcccaatgtgctggga

SEQ ID NO: 94506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccaatgtgctgggattatag

SEQ ID NO: 94507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggattataggcgtgagccac

SEQ ID NO: 94508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taggcgtgagccacagtgcc

SEQ ID NO: 94509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taacctattttatttacttt

SEQ ID NO: 94510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttatttactttatatgtc

SEQ ID NO: 94511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttactttatatgtcatg

SEQ ID NO: 94512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttactttatatgtcatgg

SEQ ID NO: 94513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttactttatatgtcatgga

SEQ ID NO: 94514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttatatgtcatggagat

SEQ ID NO: 94515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttatatgtcatggagata

SEQ ID NO: 94516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatatgtcatggagatagtt

SEQ ID NO: 94517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatgtcatggagatagttt

SEQ ID NO: 94518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgtcatggagatagtttc

SEQ ID NO: 94519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cataaaaatgacaacgaaat

SEQ ID NO: 94520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ataaaaatgacaacgaaata

SEQ ID NO: 94521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatagtggtataatgttc

SEQ ID NO: 94522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatagtggtataatgttct

SEQ ID NO: 94523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagtggtataatgttctctc

SEQ ID NO: 94524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctcaaaataaccacaaatt

SEQ ID NO: 94525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcaaaataaccacaaattga

SEQ ID NO: 94526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaataaccacaaattgaag

SEQ ID NO: 94527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aagactagcatttatactgt

SEQ ID NO: 94528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gcatttatactgtttccatt

SEQ ID NO: 94529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atactgtttccatttttgtt

SEQ ID NO: 94530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tactgtttccatttttgtta

SEQ ID NO: 94531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttccatttttgttactgaa

SEQ ID NO: 94532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccatttttgttactgaaatg

SEQ ID NO: 94533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catttttgttactgaaatga

SEQ ID NO: 94534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgttactgaaatgaatatc

SEQ ID NO: 94535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttactgaaatgaatatct

SEQ ID NO: 94536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttactgaaatgaatatcta

SEQ ID NO: 94537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttactgaaatgaatatctaa

SEQ ID NO: 94538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgaaatgaatatctaaata

SEQ ID NO: 94539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaatgaatatctaaatagct

SEQ ID NO: 94540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatagctatgttctcctaat

SEQ ID NO: 94541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgttctcctaattgcatgag

SEQ ID NO: 94542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcctaattgcatgagtactt

SEQ ID NO: 94543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ctaattgcatgagtactttt

SEQ ID NO: 94544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgcatgagtactttttaa

SEQ ID NO: 94545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catgagtactttttaataat

SEQ ID NO: 94546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaataatatgttaataga

SEQ ID NO: 94547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaataatatgttaatagaa

SEQ ID NO: 94548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taataatatgttaatagaac

SEQ ID NO: 94549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataatatgttaatagaact

SEQ ID NO: 94550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataatatgttaatagaactt

SEQ ID NO: 94551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atagaacttgggtcaacagt

SEQ ID NO: 94552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gggtcaacagtatatatatg

SEQ ID NO: 94553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggtcaacagtatatatatgt

SEQ ID NO: 94554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatatatacacacactata

SEQ ID NO: 94555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatatacacacactatat

SEQ ID NO: 94556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatacacacatactatat

SEQ ID NO: 94557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatacacatactatat

SEQ ID NO: 94558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatactatatacagtata

SEQ ID NO: 94559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatacagtatatagtataca

SEQ ID NO: 94560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacatatacatatactatac

SEQ ID NO: 94561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacatatacatatacatata

SEQ ID NO: 94562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtatacgtatatacagtac

SEQ ID NO: 94563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatagtatgtatatatagca

SEQ ID NO: 94564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatatagcatatagtatgca

SEQ ID NO: 94565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatagcatatagtatgcata

SEQ ID NO: 94566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatagcatatagtatgcata

SEQ ID NO: 94567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatagtatagagtatgcg

SEQ ID NO: 94568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatagtatagagtatg

SEQ ID NO: 94569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatagtatagagtatg

SEQ ID NO: 94570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatagtatagagtatg

SEQ ID NO: 94571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatagtatagagtatg

SEQ ID NO: 94572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatagtatagagtatg

SEQ ID NO: 94573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatagtatagagtatg

SEQ ID NO: 94574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatatatagtatagagtatg

SEQ ID NO: 94575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatactatatacatagtatg

SEQ ID NO: 94576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tactatatacatagtatgtg

SEQ ID NO: 94577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatacatagtatgtgtgtgt

SEQ ID NO: 94578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aacctatctccagaaagcct

SEQ ID NO: 94579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tctccagaaagcctgtacta

SEQ ID NO: 94580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagaaagcctgtactaatta

SEQ ID NO: 94581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tactaattaacatttctaat

SEQ ID NO: 94582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaacatttctaatggcag

SEQ ID NO: 94583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatttctaatggcagtata

SEQ ID NO: 94584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaatggcagtatatgatag

SEQ ID NO: 94585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatggcagtatatgatagt

SEQ ID NO: 94586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atggcagtatatgatagtgc

SEQ ID NO: 94587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atactttacacattcaacag

SEQ ID NO: 94588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacacattcaacagtattga

SEQ ID NO: 94589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acacattcaacagtattgag

SEQ ID NO: 94590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cacattcaacagtattgagt

SEQ ID NO: 94591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacagtattgagtgctacca

SEQ ID NO: 94592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agtgctaccattcttcttta

SEQ ID NO: 94593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccattcttctttatagtttt

SEQ ID NO: 94594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctttatagttttttacca

SEQ ID NO: 94595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttatagttttttaccaaa

SEQ ID NO: 94596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttatagttttttaccaaaa

SEQ ID NO: 94597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatagttttttaccaaaaaa

SEQ ID NO: 94598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagttttttaccaaaaaat

SEQ ID NO: 94599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagttttttaccaaaaaatt

SEQ ID NO: 94600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaccaaaaaattttcatg

SEQ ID NO: 94601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaccaaaaaattttcatga

SEQ ID NO: 94602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taccaaaaaattttcatgac

SEQ ID NO: 94603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
accaaaaaattttcatgaca

SEQ ID NO: 94604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccaaaaaattttcatgacat

SEQ ID NO: 94605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgacatttgaaaacatc

SEQ ID NO: 94606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgacatttgaaaacatct

SEQ ID NO: 94607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgacatttgaaaacatcta

SEQ ID NO: 94608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaacatctactattgtaa

SEQ ID NO: 94609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaacatctactattgtaat

SEQ ID NO: 94610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctattgtaatttatttgcat

SEQ ID NO: 94611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgtaatttatttgcatttt

SEQ ID NO: 94612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taatttatttgcattttttg

SEQ ID NO: 94613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttgcattttttgtgaaaa

SEQ ID NO: 94614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttgcattttttgtgaaaat

SEQ ID NO: 94615 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcattttttgtgaaaataat

SEQ ID NO: 94616 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattttttgtgaaaataatc

SEQ ID NO: 94617 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtgaaaataatccacaa

SEQ ID NO: 94618 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgaaaataatccacaat

SEQ ID NO: 94619 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgaaaataatccacaatt

SEQ ID NO: 94620 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgaaaataatccacaattt

SEQ ID NO: 94621 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaaaataatccacaatttt

SEQ ID NO: 94622 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttgtgttttgttatttt

SEQ ID NO: 94623 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttgtgttttgttattttg

SEQ ID NO: 94624 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgtgttttgttattttgt

SEQ ID NO: 94625 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgttttgttattttgtatc

SEQ ID NO: 94626 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttttgttattttgtatcc

SEQ ID NO: 94627 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttattttgtatccttatt

SEQ ID NO: 94628 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttattttgtatccttattg

SEQ ID NO: 94629 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttattttgtatccttattgg

SEQ ID NO: 94630 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttgtatccttattggttg

SEQ ID NO: 94631 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtatccttattggttgttt

SEQ ID NO: 94632 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtatccttattggttgtttt

SEQ ID NO: 94633 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tatccttattggttgttttt

SEQ ID NO: 94634 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attggttgtttttaacttct

SEQ ID NO: 94635 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttggttgtttttaacttctg

SEQ ID NO: 94636 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttgtttttaacttctgttt

SEQ ID NO: 94637 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttaacttctgtttttgg

SEQ ID NO: 94638 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaacttctgtttttggctt

SEQ ID NO: 94639 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taacttctgtttttggctta

SEQ ID NO: 94640 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacttctgtttttggcttag

SEQ ID NO: 94641 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttctgtttttggcttagt

SEQ ID NO: 94642 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtttttggcttagtttgg

SEQ ID NO: 94643 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtttttggcttagtttggt

SEQ ID NO: 94644 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tttttggcttagtttggtat

SEQ ID NO: 94645 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggcttagtttggtatttg

SEQ ID NO: 94646 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggcttagtttggtatttgc

SEQ ID NO: 94647 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcttagtttggtatttgcc

SEQ ID NO: 94648 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttagtttggtatttgccc

SEQ ID NO: 94649 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
agtttggtatttgcccatgt

SEQ ID NO: 94650 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtttggtatttgcccatgtg

SEQ ID NO: 94651 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtatttgcccatgtgtcta

SEQ ID NO: 94652 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtatttgcccatgtgtctat

SEQ ID NO: 94653 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcccatgtgtctattgggat

SEQ ID NO: 94654 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cccatgtgtctattgggatt

SEQ ID NO: 94655 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttgggatttttactatattc

SEQ ID NO: 94656 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggatttttactatattctta

SEQ ID NO: 94657 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttactatattcttattaatt

SEQ ID NO: 94658 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tactatattcttattaattt

SEQ ID NO: 94659 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actatattcttattaattta

SEQ ID NO: 94660 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctatattcttattaatttat

SEQ ID NO: 94661 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tattcttattaatttataag

SEQ ID NO: 94662 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttattaatttataagaacaa

SEQ ID NO: 94663 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
attaatttataagaacaatt

SEQ ID NO: 94664 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttaatttataagaacaattt

SEQ ID NO: 94665 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttataagaacaattttct

SEQ ID NO: 94666 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataagaacaattttctattt

SEQ ID NO: 94667 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taagaacaattttctattta

SEQ ID NO: 94668 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctatttaaagtattgatcc

SEQ ID NO: 94669 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatttaaagtattgatcct

SEQ ID NO: 94670 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatttaaagtattgatcctt

SEQ ID NO: 94671 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttaaagtattgatcctttc

SEQ ID NO: 94672 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagtattgatcctttctcg

SEQ ID NO: 94673 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtattgatcctttctcgg

SEQ ID NO: 94674 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atcctttctcggccttaact

SEQ ID NO: 94675 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctcggccttaactgttatg

SEQ ID NO: 94676 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctcggccttaactgttatgt

SEQ ID NO: 94677 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcggccttaactgttatgta

SEQ ID NO: 94678 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ggccttaactgttatgtaaa

SEQ ID NO: 94679 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aactgttatgtaaacatttc

SEQ ID NO: 94680 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actgttatgtaaacatttca

SEQ ID NO: 94681 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttatgtaaacatttcaccta

SEQ ID NO: 94682 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtaaacatttcacctattt

SEQ ID NO: 94683 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacctattttttgtctttca

SEQ ID NO: 94684 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acctattttttgtctttcaa

SEQ ID NO: 94685 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttttttgtctttcaaccttt

SEQ ID NO: 94686 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtctttcaaccttttat

SEQ ID NO: 94687 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtctttcaaccttttatt

SEQ ID NO: 94688 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtctttcaaccttttattt

SEQ ID NO: 94689 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctttcaaccttttattta

SEQ ID NO: 94690 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctttcaaccttttatttat

SEQ ID NO: 94691 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaaccttttatttatgatg

SEQ ID NO: 94692 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaccttttatttatgatga

SEQ ID NO: 94693 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaccttttatttatgatgat

SEQ ID NO: 94694 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatttatgatgattttttc

SEQ ID NO: 94695 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttatgatgattttttcc

SEQ ID NO: 94696 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttatgatgattttttccc

SEQ ID NO: 94697 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttatgatgattttttcccc

SEQ ID NO: 94698 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgatgattttttccccaaa

SEQ ID NO: 94699 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgatgattttttccccaaag

SEQ ID NO: 94700 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttccccaaagaatattttg

SEQ ID NO: 94701 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttccccaaagaatattttgt

SEQ ID NO: 94702 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccccaaagaatattttgtt

SEQ ID NO: 94703 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccccaaagaatattttgttt

SEQ ID NO: 94704 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cccaaagaatattttgtttt

SEQ ID NO: 94705 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtttttttgtgcagtcatt

SEQ ID NO: 94706 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtttttttgtgcagtcattt

SEQ ID NO: 94707 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttttgtgcagtcatttc

SEQ ID NO: 94708 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttgtgcagtcatttcttc

SEQ ID NO: 94709 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttgtgcagtcatttcttct

SEQ ID NO: 94710 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtgcagtcatttcttctt

SEQ ID NO: 94711 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtgcagtcatttcttcttc

SEQ ID NO: 94712 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgcagtcatttcttcttca

SEQ ID NO: 94713 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgcagtcatttcttcttcat

SEQ ID NO: 94714 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcttcatttttttttttg

SEQ ID NO: 94715 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcttcatttttttttttgg

SEQ ID NO: 94716 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttcatttttttttttggct

SEQ ID NO: 94717 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcatttttttttttggctt

SEQ ID NO: 94718 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catttttttttttggcttta

SEQ ID NO: 94719 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atttttttttttggctttac

SEQ ID NO: 94720 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttttggctttacaaat

SEQ ID NO: 94721 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttggctttacaaatt

SEQ ID NO: 94722 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttggctttacaaattt

SEQ ID NO: 94723 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttggctttacaaatttg

SEQ ID NO: 94724 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttggctttacaaatttgt

SEQ ID NO: 94725 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttggctttacaaatttgtg

SEQ ID NO: 94726 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttggctttacaaatttgtgt

SEQ ID NO: 94727 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggctttacaaatttgtgtt

SEQ ID NO: 94728 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctttacaaatttgtgttt

SEQ ID NO: 94729 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttacaaatttgtgtttt

SEQ ID NO: 94730 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacaaatttgtgttttgcat

SEQ ID NO: 94731 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaaatttgtgttttgcata

SEQ ID NO: 94732 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaatttgtgttttgcatag

SEQ ID NO: 94733 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgttttgcatagaaaggac

SEQ ID NO: 94734 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttttgcatagaaaggact

SEQ ID NO: 94735 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcatagaaaggactataag

SEQ ID NO: 94736 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcatagaaaggactataaga

SEQ ID NO: 94737 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
catagaaaggactataagag

SEQ ID NO: 94738 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taagagtatatggttatatg

SEQ ID NO: 94739 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgtctatttccacatatt

SEQ ID NO: 94740 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttccacatatttcctacta

SEQ ID NO: 94741 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccacatatttcctactagaa

SEQ ID NO: 94742 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cacatatttcctactagaat

SEQ ID NO: 94743 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctactagaatctttttttt

SEQ ID NO: 94744 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctactagaatcttttttttt

SEQ ID NO: 94745 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctagaatctttttttttaac

SEQ ID NO: 94746 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaatctttttttttaacttt

SEQ ID NO: 94747 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttttttaactttagatttt

SEQ ID NO: 94748 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttaactttagattttg

SEQ ID NO: 94749 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttaactttagattttga

SEQ ID NO: 94750 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttaactttagattttgat

SEQ ID NO: 94751 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttaactttagattttgatt

SEQ ID NO: 94752 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaactttagattttgattc

SEQ ID NO: 94753 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taactttagattttgattca

SEQ ID NO: 94754 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aactttagattttgattcat

SEQ ID NO: 94755 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actttagattttgattcatg

SEQ ID NO: 94756 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tagattttgattcatgtgat

SEQ ID NO: 94757 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agattttgattcatgtgatc

SEQ ID NO: 94758 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gattttgattcatgtgatct

SEQ ID NO: 94759 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgattcatgtgatcttttca

SEQ ID NO: 94760 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gattcatgtgatcttttcac

SEQ ID NO: 94761 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attcatgtgatcttttcaca

SEQ ID NO: 94762 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtgatcttttcacacagt

SEQ ID NO: 94763 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcacacagtaaattggtaa

SEQ ID NO: 94764 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacacagtaaattggtaat

SEQ ID NO: 94765 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacacagtaaattggtaatt

SEQ ID NO: 94766 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acacagtaaattggtaatta

SEQ ID NO: 94767 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaattatacattaaagttt

SEQ ID NO: 94768 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacattaaagtttaatttgg

SEQ ID NO: 94769 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtttaatttggactctct

SEQ ID NO: 94770 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatttggactctcttcaaac

SEQ ID NO: 94771 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atttggactctcttcaaacc

SEQ ID NO: 94772 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggactctcttcaaacccact

SEQ ID NO: 94773 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gactctcttcaaacccactg

SEQ ID NO: 94774 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttcaaacccactgagctt

SEQ ID NO: 94775 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcaaacccactgagctttt

SEQ ID NO: 94776 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaacccactgagcttttat

SEQ ID NO: 94777 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaacccactgagcttttata

SEQ ID NO: 94778 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agcttttatatttgaacagt

SEQ ID NO: 94779 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatatttgaacagttttat

SEQ ID NO: 94780 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatttgaacagttttatt

SEQ ID NO: 94781 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatttgaacagttttattt

SEQ ID NO: 94782 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatttgaacagttttattta

SEQ ID NO: 94783 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaacagttttatttaacatc

SEQ ID NO: 94784 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacagttttatttaacatct

SEQ ID NO: 94785 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatttaacatctatatgtct

SEQ ID NO: 94786 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttaacatctatatgtctt

SEQ ID NO: 94787 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttaacatctatatgtctta

SEQ ID NO: 94788 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aacatctatatgtcttaata

SEQ ID NO: 94789 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acatctatatgtcttaatat

SEQ ID NO: 94790 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatgtcttaatattttgcag

SEQ ID NO: 94791 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aatattttgcagaataagcc

SEQ ID NO: 94792 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattttgcagaataagcca

SEQ ID NO: 94793 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcagaataagccacctctt

SEQ ID NO: 94794 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcagaataagccacctcttg

SEQ ID NO: 94795 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagaataagccacctcttgt

SEQ ID NO: 94796 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttgtcaccctaattttcttc

SEQ ID NO: 94797 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtcaccctaattttcttcca

SEQ ID NO: 94798 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcaccctaattttcttccag

SEQ ID NO: 94799 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attttcttccagatgaattt

SEQ ID NO: 94800 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttccagatgaatttagaa

SEQ ID NO: 94801 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttccagatgaatttagaat

SEQ ID NO: 94802 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttccagatgaatttagaatc

SEQ ID NO: 94803 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccagatgaatttagaatcat

SEQ ID NO: 94804 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cagatgaatttagaatcatt

SEQ ID NO: 94805 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaatcatttagacttatat

SEQ ID NO: 94806 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatcatttagacttatatt

SEQ ID NO: 94807 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agacttatattgtttttgtc

SEQ ID NO: 94808 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gacttatattgtttttgtct

SEQ ID NO: 94809 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atattgtttttgtctattta

SEQ ID NO: 94810 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattgtttttgtctatttat

SEQ ID NO: 94811 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttgtctatttattaccc

SEQ ID NO: 94812 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgtctatttattacccaca

SEQ ID NO: 94813 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtctatttattacccacac

SEQ ID NO: 94814 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtctatttattacccacact

SEQ ID NO: 94815 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctatttattacccacacta

SEQ ID NO: 94816 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttattacccacactacata

SEQ ID NO: 94817 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attacccacactacataaaa

SEQ ID NO: 94818 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttacccacactacataaaaa

SEQ ID NO: 94819 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccacactacataaaaagac

SEQ ID NO: 94820 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cataaaaagactcattgata

SEQ ID NO: 94821 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attgatattttccttgaatt

SEQ ID NO: 94822 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atattttccttgaatttata

SEQ ID NO: 94823 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccttgaatttatagattaa

SEQ ID NO: 94824 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttgaatttatagattaat

SEQ ID NO: 94825 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgaatttatagattaata

SEQ ID NO: 94826 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaatttatagattaataaat

SEQ ID NO: 94827 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatttatagattaataaatt

SEQ ID NO: 94828 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagattaataaatttgaaa

SEQ ID NO: 94829 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagattaataaatttgaaag

SEQ ID NO: 94830 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaatttgaaagtcttaat

SEQ ID NO: 94831 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaagtcttaattacaatga

SEQ ID NO: 94832 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaagtcttaattacaatgag

SEQ ID NO: 94833 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aattacaatgagagaagctt

SEQ ID NO: 94834 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attacaatgagagaagctta

SEQ ID NO: 94835 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caatgagagaagcttatcta

SEQ ID NO: 94836 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctaagtacatgacaatcc

SEQ ID NO: 94837 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaagtacatgacaatcct

SEQ ID NO: 94838 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtacatgacaatcctttca

SEQ ID NO: 94839 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaattattttagctttctt

SEQ ID NO: 94840 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caattattttagctttcttt

SEQ ID NO: 94841 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aattattttagctttctttt

SEQ ID NO: 94842 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttagctttcttttatatc

SEQ ID NO: 94843 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagctttcttttatatccta

SEQ ID NO: 94844 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctttcttttatatcctaa

SEQ ID NO: 94845 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctttcttttatatcctaaa

SEQ ID NO: 94846 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttttatatcctaaagttt

SEQ ID NO: 94847 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttttatatcctaaagtttt

SEQ ID NO: 94848 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttatatcctaaagttttc

SEQ ID NO: 94849 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatatcctaaagttttctt

SEQ ID NO: 94850 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatcctaaagttttcttc

SEQ ID NO: 94851 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatcctaaagttttcttca

SEQ ID NO: 94852 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcctaaagttttcttcag

SEQ ID NO: 94853 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagttttcttcagaagtctc

SEQ ID NO: 94854 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttcagaagtctcatatga

SEQ ID NO: 94855 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcagaagtctcatatgat

SEQ ID NO: 94856 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcagaagtctcatatgata

SEQ ID NO: 94857 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagaagtctcatatgataaa

SEQ ID NO: 94858 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaagtctcatatgataaag

SEQ ID NO: 94859 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atatgataaagttattatta

SEQ ID NO: 94860 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttattagataatttacttta

SEQ ID NO: 94861 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagataatttactttattt

SEQ ID NO: 94862 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gataatttactttattttta

SEQ ID NO: 94863 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actttatttttattgcaatt

SEQ ID NO: 94864 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctttatttttattgcaattg

SEQ ID NO: 94865 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tatttttattgcaattgtga

SEQ ID NO: 94866 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttattgcaattgtgaa

SEQ ID NO: 94867 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttattgcaattgtgaat

SEQ ID NO: 94868 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttattgcaattgtgaatcag

SEQ ID NO: 94869 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgcaattgtgaatcaga

SEQ ID NO: 94870 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgcaattgtgaatcagat

SEQ ID NO: 94871 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgcaattgtgaatcagatt

SEQ ID NO: 94872 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caattgtgaatcagattttc

SEQ ID NO: 94873 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaatcagattttctaattt

SEQ ID NO: 94874 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctaatttttttcatgtata

SEQ ID NO: 94875 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaatttttttcatgtataa

SEQ ID NO: 94876 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatttttttcatgtataag

SEQ ID NO: 94877 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttttttcatgtataagat

SEQ ID NO: 94878 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcatgtataagataatt

SEQ ID NO: 94879 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcatgtataagataatta

SEQ ID NO: 94880 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcatgtataagataattat

SEQ ID NO: 94881 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcatgtataagataattatt

SEQ ID NO: 94882 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
catgtataagataattatta

SEQ ID NO: 94883 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtataagataattattag

SEQ ID NO: 94884 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttagtgttggcacatgtaat

SEQ ID NO: 94885 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgttggcacatgtaattta

SEQ ID NO: 94886 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcacatgtaatttaaaattt

SEQ ID NO: 94887 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaatttgtaccttttgaac

SEQ ID NO: 94888 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatttgtaccttttgaact

SEQ ID NO: 94889 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaccttttgaactctaatt

SEQ ID NO: 94890 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taccttttgaactctaattg

SEQ ID NO: 94891 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgaactctaattgaattta

SEQ ID NO: 94892 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgaactctaattgaatttat

SEQ ID NO: 94893 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaactctaattgaatttatt

SEQ ID NO: 94894 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aactctaattgaatttattt

SEQ ID NO: 94895 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taattgaatttatttttagt

SEQ ID NO: 94896 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgaatttatttttagttg

SEQ ID NO: 94897 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aatttatttttagttgattc

SEQ ID NO: 94898 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atttttagttgattctcttt

SEQ ID NO: 94899 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttagttgattctctttc

SEQ ID NO: 94900 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttagttgattctctttcaat

SEQ ID NO: 94901 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagttgattctctttcaata

SEQ ID NO: 94902 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agttgattctctttcaatat

SEQ ID NO: 94903 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gttgattctctttcaatata

SEQ ID NO: 94904 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attctctttcaatatatgaa

SEQ ID NO: 94905 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctttcaatatatgaacaag

SEQ ID NO: 94906 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttcaatatatgaacaagtt

SEQ ID NO: 94907 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcaatatatgaacaagttct

SEQ ID NO: 94908 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caatatatgaacaagttctt

SEQ ID NO: 94909 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatatatgaacaagttcttt

SEQ ID NO: 94910 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcattatatgaagaaggt

SEQ ID NO: 94911 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcattatatgaagaaggtca

SEQ ID NO: 94912 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattatatgaagaaggtcat

SEQ ID NO: 94913 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attatatgaagaaggtcatt

SEQ ID NO: 94914 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatgaagaaggtcattatat

SEQ ID NO: 94915 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattaaggatcatttactcc

SEQ ID NO: 94916 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aggatcatttactccattgt

SEQ ID NO: 94917 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actccattgtttttatatat

SEQ ID NO: 94918 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctccattgtttttatatatg

SEQ ID NO: 94919 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cattgtttttatatatgtac

SEQ ID NO: 94920 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tttttatatatgtacctctc

SEQ ID NO: 94921 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatatatgtacctctctgt

SEQ ID NO: 94922 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatatatgtacctctctgtt

SEQ ID NO: 94923 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atatatgtacctctctgttt

SEQ ID NO: 94924 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatatgtacctctctgtttt

SEQ ID NO: 94925 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctgttttcttatctaattg

SEQ ID NO: 94926 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttttcttatctaattgca

SEQ ID NO: 94927 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttttcttatctaattgcatt

SEQ ID NO: 94928 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttatctaattgcattggc

SEQ ID NO: 94929 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatctaattgcattggcc

SEQ ID NO: 94930 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatctaattgcattggcca

SEQ ID NO: 94931 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atctaattgcattggccaac

SEQ ID NO: 94932 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctaattgcattggccaaca

SEQ ID NO: 94933 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attgcattggccaacaacac

SEQ ID NO: 94934 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattggccaacaacactaaa

SEQ ID NO: 94935 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gccaacaacactaaaaacag

SEQ ID NO: 94936 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaacagggatgatacaggc

SEQ ID NO: 94937 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttttttttttcctgacttaa

SEQ ID NO: 94938 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttttttcctgacttaata

SEQ ID NO: 94939 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttttcctgacttaatag

SEQ ID NO: 94940 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttttcctgacttaatagg

SEQ ID NO: 94941 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttttcctgacttaatagga

SEQ ID NO: 94942 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttcctgacttaataggaa

SEQ ID NO: 94943 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcctgacttaataggaat

SEQ ID NO: 94944 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcctgacttaataggaatg

SEQ ID NO: 94945 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcctgacttaataggaatgc

SEQ ID NO: 94946 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cctgacttaataggaatgct

SEQ ID NO: 94947 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctgacttaataggaatgctt

SEQ ID NO: 94948 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttaataggaatgctttca

SEQ ID NO: 94949 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aataggaatgctttcagaat

SEQ ID NO: 94950 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataggaatgctttcagaatc

SEQ ID NO: 94951 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcagaatcatttttgttagt

SEQ ID NO: 94952 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagaatcatttttgttagtg

SEQ ID NO: 94953 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agaatcatttttgttagtgt

SEQ ID NO: 94954 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgttagtgtgaaattctca

SEQ ID NO: 94955 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttagtgtgaaattctcac

SEQ ID NO: 94956 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttagtgtgaaattctcacc

SEQ ID NO: 94957 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttagtgtgaaattctcacct

SEQ ID NO: 94958 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtgtgaaattctcacctaaa

SEQ ID NO: 94959 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcacctaaattttaatacat

SEQ ID NO: 94960 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acctaaattttaatacattt

SEQ ID NO: 94961 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aattttaatacattttctta

SEQ ID NO: 94962 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatacattttcttatatca

SEQ ID NO: 94963 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatacattttcttatatcaa

SEQ ID NO: 94964 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atacattttcttatatcaat

SEQ ID NO: 94965 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcttatatcaattttggtat

SEQ ID NO: 94966 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttatatcaattttggtatg

SEQ ID NO: 94967 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttatatcaattttggtatga

SEQ ID NO: 94968 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atatcaattttggtatgact

SEQ ID NO: 94969 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tatcaattttggtatgactt

SEQ ID NO: 94970 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtatgacttctggtgata

SEQ ID NO: 94971 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtatgacttctggtgataa

SEQ ID NO: 94972 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtatgacttctggtgataat

SEQ ID NO: 94973 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctggtgataatatgcttttc

SEQ ID NO: 94974 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggtgataatatgcttttcc

SEQ ID NO: 94975 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtgataatatgcttttccaa

SEQ ID NO: 94976 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttccaaaattattgatttta

SEQ ID NO: 94977 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaaaattattgattttaa

SEQ ID NO: 94978 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaaaattattgattttaaa

SEQ ID NO: 94979 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caaaattattgattttaaat

SEQ ID NO: 94980 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgattttaaatgcttactc

SEQ ID NO: 94981 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attttaaatgcttactctgt

SEQ ID NO: 94982 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaatgcttactctgttatg

SEQ ID NO: 94983 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaatgcttactctgttatgt

SEQ ID NO: 94984 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgcttactctgttatgtg

SEQ ID NO: 94985 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actctgttatgtggcactca

SEQ ID NO: 94986 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctctgttatgtggcactcaa

SEQ ID NO: 94987 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgttatgtggcactcaattt

SEQ ID NO: 94988 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttatgtggcactcaatttta

SEQ ID NO: 94989 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtggcactcaattttatga

SEQ ID NO: 94990 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aattttatgattctaagtca

SEQ ID NO: 94991 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatgattctaagtcatgcaa

SEQ ID NO: 94992 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgattctaagtcatgcaac

SEQ ID NO: 94993 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgattctaagtcatgcaacc

SEQ ID NO: 94994 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taagtcatgcaaccttgaac

SEQ ID NO: 94995 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agtcatgcaaccttgaacct

SEQ ID NO: 94996 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gaaccttttcagattgataa

SEQ ID NO: 94997 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaccttttcagattgataac

SEQ ID NO: 94998 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcagattgataacctgttg

SEQ ID NO: 94999 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcagattgataacctgttga

SEQ ID NO: 95000 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagattgataacctgttgat

SEQ ID NO: 95001 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agattgataacctgttgatt

SEQ ID NO: 95002 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ataacctgttgattaaactt

SEQ ID NO: 95003 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttgattaaacttgtagtaat

SEQ ID NO: 95004 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attaaacttgtagtaatctc

SEQ ID NO: 95005 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacttgtagtaatctctata

SEQ ID NO: 95006 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagtaatctctataatctc

SEQ ID NO: 95007 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagtaatctctataatctct

SEQ ID NO: 95008 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tataatctctctctcttaaa

SEQ ID NO: 95009 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatctctctctcttaaaag

SEQ ID NO: 95010 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctctcttaaaagtttataa

SEQ ID NO: 95011 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tctcttaaaagtttataatt

SEQ ID NO: 95012 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tcttaaaagtttataattct

SEQ ID NO: 95013 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttaaaagtttataattctaa

SEQ ID NO: 95014 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaaagtttataattctaaaa

SEQ ID NO: 95015 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtttataattctaaaaa

SEQ ID NO: 95016 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataattctaaaaagaaatac

SEQ ID NO: 95017 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taattctaaaaagaaataca

SEQ ID NO: 95018 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaaaagaaatacaatccta

SEQ ID NO: 95019 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagaaatacaatcctaaa

SEQ ID NO: 95020 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatactttgcaagatatgt

SEQ ID NO: 95021 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgcaagatatgtgaaaataa

SEQ ID NO: 95022 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaagatatgtgaaaataac

SEQ ID NO: 95023 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caagatatgtgaaaataaca

SEQ ID NO: 95024 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttattcacagacatgaacac

SEQ ID NO: 95025 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcacagacatgaacaccat

SEQ ID NO: 95026 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagacatgaacaccatggc

SEQ ID NO: 95027 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttgaggaatgattggcatt

SEQ ID NO: 95028 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aggaatgattggcattttat

SEQ ID NO: 95029 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcattttatacacttgtgaa

SEQ ID NO: 95030 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatacacttgtgaagtatta

SEQ ID NO: 95031 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atacacttgtgaagtattaa

SEQ ID NO: 95032 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tacacttgtgaagtattaag

SEQ ID NO: 95033 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtgaagtattaagctgtaaa

SEQ ID NO: 95034 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgaagtattaagctgtaaaa

SEQ ID NO: 95035 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agctgtaaaaaataaaactg

SEQ ID NO: 95036 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taaaaaataaaactggcatt

SEQ ID NO: 95037 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gcatttctagagatcttaac

SEQ ID NO: 95038 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctagagatcttaacttcact

SEQ ID NO: 95039 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tagagatcttaacttcactt

SEQ ID NO: 95040 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gagatcttaacttcacttta

SEQ ID NO: 95041 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacttcactttaaattctgg

SEQ ID NO: 95042 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttcactttaaattctgga

SEQ ID NO: 95043 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cactttaaattctggaagaa

SEQ ID NO: 95044 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
actttaaattctggaagaat

SEQ ID NO: 95045 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaattctggaagaattttc

SEQ ID NO: 95046 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaattctggaagaattttca

SEQ ID NO: 95047 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aattctggaagaattttcac

SEQ ID NO: 95048 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggaagaattttcacaaatt

SEQ ID NO: 95049 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaagaattttcacaaattca

SEQ ID NO: 95050 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcacaaattcacagatattc

SEQ ID NO: 95051 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacaaattcacagatattct

SEQ ID NO: 95052 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaaattcacagatattctg

SEQ ID NO: 95053 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acagatattctggctattaa

SEQ ID NO: 95054 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tggctattaatattatcatt

SEQ ID NO: 95055 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctattaatattatcattaa

SEQ ID NO: 95056 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttaatattatcattaatcaa

SEQ ID NO: 95057 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atattatcattaatcaaatg

SEQ ID NO: 95058 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcattaatcaaatgacaagt

SEQ ID NO: 95059 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atcaaatgacaagtctcaca

SEQ ID NO: 95060 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acatgtgctaaaaccagaag

SEQ ID NO: 95061 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaccagaagttatttcaga

SEQ ID NO: 95062 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttcagattcaacattggtt

SEQ ID NO: 95063 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cagattcaacattggttttc

SEQ ID NO: 95064 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agattcaacattggttttcc

SEQ ID NO: 95065 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacattggttttccaagaca

SEQ ID NO: 95066 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gttttccaagacacagctat

SEQ ID NO: 95067 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tccaagacacagctatatat

SEQ ID NO: 95068 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaagacacagctatatata

SEQ ID NO: 95069 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caagacacagctatatataa

SEQ ID NO: 95070 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatataaacatggtaactag

SEQ ID NO: 95071 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gttttgcaaaggtaatattg

SEQ ID NO: 95072 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcaaaggtaatattggaaa

SEQ ID NO: 95073 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaaaggtaatattggaaac

SEQ ID NO: 95074 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caaaggtaatattggaaact

SEQ ID NO: 95075 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaactaaatatcaacaagt

SEQ ID NO: 95076 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatatcaacaagtataattt

SEQ ID NO: 95077 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccttctaatagatagaaata

SEQ ID NO: 95078 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttctaatagatagaaatat

SEQ ID NO: 95079 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctaatagatagaaatatttg

SEQ ID NO: 95080 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taatagatagaaatatttgg

SEQ ID NO: 95081 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atagatagaaatatttggct

SEQ ID NO: 95082 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggctttggggcctgtagtgt

SEQ ID NO: 95083 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctttggggcctgtagtgta

SEQ ID NO: 95084 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tggggcctgtagtgtaaacc

SEQ ID NO: 95085 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggggcctgtagtgtaaaccc

SEQ ID NO: 95086 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gggcctgtagtgtaaaccca

SEQ ID NO: 95087 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtgtaaacccagaaacac

SEQ ID NO: 95088 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tagtatgagagacagatatt

SEQ ID NO: 95089 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttttgctttttaggatttt

SEQ ID NO: 95090 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttgctttttaggattttt

SEQ ID NO: 95091 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgctttttaggattttttca

SEQ ID NO: 95092 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gctttttaggattttttcat

SEQ ID NO: 95093 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctttttaggattttttcatt

SEQ ID NO: 95094 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaggattttttcattctt

SEQ ID NO: 95095 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaggattttttcattcttt

SEQ ID NO: 95096 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taggattttttcattctttc

SEQ ID NO: 95097 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aggattttttcattctttca

SEQ ID NO: 95098 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggattttttcattctttcat

SEQ ID NO: 95099 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttcattctttcattgtact

SEQ ID NO: 95100 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcattctttcattgtactg

SEQ ID NO: 95101 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattctttcattgtactga

SEQ ID NO: 95102 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattctttcattgtactgac

SEQ ID NO: 95103 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attctttcattgtactgact

SEQ ID NO: 95104 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttcattgtactgacttact

SEQ ID NO: 95105 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcattgtactgacttactca

SEQ ID NO: 95106 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattgtactgacttactcaa

SEQ ID NO: 95107 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgtactgacttactcaag

SEQ ID NO: 95108 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tactgacttactcaagagta

SEQ ID NO: 95109 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttactcaagagtaaattt

SEQ ID NO: 95110 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actcaagagtaaatttgtgt

SEQ ID NO: 95111 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcaagagtaaatttgtgtt

SEQ ID NO: 95112 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagagtaaatttgtgttcaa

SEQ ID NO: 95113 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtgttcaagaattcagcata

SEQ ID NO: 95114 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tgttcaagaattcagcatat

SEQ ID NO: 95115 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaattcagcatatacttc

SEQ ID NO: 95116 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcatatacttccttgagca

SEQ ID NO: 95117 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttgagcataagtgaagtt

SEQ ID NO: 95118 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttgagcataagtgaagttt

SEQ ID NO: 95119 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gagcataagtgaagtttagc

SEQ ID NO: 95120 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agcataagtgaagtttagct

SEQ ID NO: 95121 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agctttactcaaaaaataaa

SEQ ID NO: 95122 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctttactcaaaaaataaaa

SEQ ID NO: 95123 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tactcaaaaaataaaatctg

SEQ ID NO: 95124 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
actcaaaaaataaaatctga

SEQ ID NO: 95125 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctcaaaaaataaaatctgaa

SEQ ID NO: 95126 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaaaataaaatctgaaaaa

SEQ ID NO: 95127 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaaaataaatattcttacct

SEQ ID NO: 95128 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttacctacaatggagataat

SEQ ID NO: 95129 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acctacaatggagataatca

SEQ ID NO: 95130 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cctacaatggagataatcac

SEQ ID NO: 95131 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caatggagataatcacaacc

SEQ ID NO: 95132 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catcctacagtgaagtagta

SEQ ID NO: 95133 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtgaagtagtagtgtctg

SEQ ID NO: 95134 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agggagatcagttttagcac

SEQ ID NO: 95135 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tagcacacattctccagtga

SEQ ID NO: 95136 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agcacacattctccagtgaa

SEQ ID NO: 95137 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gcacacattctccagtgaaa

SEQ ID NO: 95138 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tccagtgaaaaggattataa

SEQ ID NO: 95139 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cagtgaaaaggattataaaa

SEQ ID NO: 95140 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaaaaccacatttatccaa

SEQ ID NO: 95141 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atccaatataaaacttcagt

SEQ ID NO: 95142 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccaatataaaacttcagtc

SEQ ID NO: 95143 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagtcatatgttgactttga

SEQ ID NO: 95144 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agtcatatgttgactttgac

SEQ ID NO: 95145 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actttgaccctccttttcta

SEQ ID NO: 95146 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgaccctccttttctaccat

SEQ ID NO: 95147 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaccctccttttctaccatc

SEQ ID NO: 95148 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
accctccttttctaccatca

SEQ ID NO: 95149 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cttttctaccatcatggtta

SEQ ID NO: 95150 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttctaccatcatggttacca

SEQ ID NO: 95151 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tctaccatcatggttaccat

SEQ ID NO: 95152 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaccatcatggttaccatg

SEQ ID NO: 95153 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taccatcatggttaccatgt

SEQ ID NO: 95154 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccatcatggttaccatgttg

SEQ ID NO: 95155 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ccatgttgagacagataaga

SEQ ID NO: 95156 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
agacagataagaaccatgat

SEQ ID NO: 95157 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atatcaaaggcttgatttgt

SEQ ID NO: 95158 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatttgtcactaggtcaaat

SEQ ID NO: 95159 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atttgtcactaggtcaaata

SEQ ID NO: 95160 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtcactaggtcaaatataca

SEQ ID NO: 95161 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tcactaggtcaaatatacat

SEQ ID NO: 95162 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtcaaatatacatccttgg

SEQ ID NO: 95163 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggattttgttctgcaaagaa

SEQ ID NO: 95164 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gattttgttctgcaaagaaa

SEQ ID NO: 95165 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgttctgcaaagaaataaga

SEQ ID NO: 95166 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttctgcaaagaaataagaa

SEQ ID NO: 95167 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttctgcaaagaaataagaat

SEQ ID NO: 95168 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcaaagaaataagaataat

SEQ ID NO: 95169 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaagaaataagaataatat

SEQ ID NO: 95170 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttcaagtattatccagaaat

SEQ ID NO: 95171 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaagtattatccagaaatt

SEQ ID NO: 95172 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagtattatccagaaatta

SEQ ID NO: 95173 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagtattatccagaaattaa

SEQ ID NO: 95174 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccagaaattaaagatgtgc

SEQ ID NO: 95175 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagatgtgcattaaaaatga

SEQ ID NO: 95176 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaatgaattagaaataatt

SEQ ID NO: 95177 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaaataatttgaaaatctat

SEQ ID NO: 95178 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gaaaatctatatgctaaaga

SEQ ID NO: 95179 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaaatctatatgctaaagat

SEQ ID NO: 95180 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatgctaaagatatatatat

SEQ ID NO: 95181 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagatatatatattttttta

SEQ ID NO: 95182 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttttacccctggtcgaggaa

SEQ ID NO: 95183 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttacccctggtcgaggaat

SEQ ID NO: 95184 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttacccctggtcgaggaatt

SEQ ID NO: 95185 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacccctggtcgaggaattg

SEQ ID NO: 95186 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acccctggtcgaggaattgg

SEQ ID NO: 95187 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cccctggtcgaggaattggc

SEQ ID NO: 95188 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtcgaggaattggcttttgt

SEQ ID NO: 95189 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcttttgtggcttcttggac

SEQ ID NO: 95190 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttgtggcttcttggacccca

SEQ ID NO: 95191 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgtggcttcttggaccccag

SEQ ID NO: 95192 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtggcttcttggaccccagc

SEQ ID NO: 95193 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggcttcttggaccccagct

SEQ ID NO: 95194 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cttggaccccagctttttca

SEQ ID NO: 95195 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttggaccccagctttttcat

SEQ ID NO: 95196 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaccccagctttttcattg

SEQ ID NO: 95197 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaccccagctttttcattgc

SEQ ID NO: 95198 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttcattgcattatagtatt

SEQ ID NO: 95199 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttcattgcattatagtattt

SEQ ID NO: 95200 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcattgcattatagtatttc

SEQ ID NO: 95201 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cattgcattatagtatttct

SEQ ID NO: 95202 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attgcattatagtatttctt

SEQ ID NO: 95203 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cattatagtatttcttctgt

SEQ ID NO: 95204 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagtatttcttctgttcttc

SEQ ID NO: 95205 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttctgttcttctgtcataa

SEQ ID NO: 95206 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctgttcttctgtcataaa

SEQ ID NO: 95207 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgttcttctgtcataaaga

SEQ ID NO: 95208 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgttcttctgtcataaagat

SEQ ID NO: 95209 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttcttctgtcataaagatgt

SEQ ID NO: 95210 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttctgtcataaagatgtctt

SEQ ID NO: 95211 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgtcataaagatgtcttga

SEQ ID NO: 95212 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgtcataaagatgtcttgac

SEQ ID NO: 95213 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcataaagatgtcttgacct

SEQ ID NO: 95214 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacctccaaggtaaagaaac

SEQ ID NO: 95215 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acctccaaggtaaagaaaca

SEQ ID NO: 95216 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaggtaaagaaacaaacaa

SEQ ID NO: 95217 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaaccagaatcattgtctac

SEQ ID NO: 95218 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tctacatctttctatagatt

SEQ ID NO: 95219 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catctttctatagattacta

SEQ ID NO: 95220 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tctatagattactaaaatag

SEQ ID NO: 95221 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatagattactaaaatagg

SEQ ID NO: 95222 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatagattactaaaataggt

SEQ ID NO: 95223 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tagattactaaaataggtta

SEQ ID NO: 95224 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctaaaataggttaaaatgtg

SEQ ID NO: 95225 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaataggttaaaatgtgtta

SEQ ID NO: 95226 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaatgtgttaatatagaaat

SEQ ID NO: 95227 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atatagaaataaaatgtatt

SEQ ID NO: 95228 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattatgttcatgatagcta

SEQ ID NO: 95229 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attatgttcatgatagctat

SEQ ID NO: 95230 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttatgttcatgatagctata

SEQ ID NO: 95231 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgttcatgatagctatacat

SEQ ID NO: 95232 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgatagctatacataaaat

SEQ ID NO: 95233 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tacataaaatatatcttaaa

SEQ ID NO: 95234 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaataattacatatgtgtag

SEQ ID NO: 95235 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aataattacatatgtgtaga

SEQ ID NO: 95236 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catatgtgtagaaacatggg

SEQ ID NO: 95237 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
caaacacagttaaatgtgca

SEQ ID NO: 95238 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtgcatatataaatatt

SEQ ID NO: 95239 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtattacatataataaggat

SEQ ID NO: 95240 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattacatataataaggatt

SEQ ID NO: 95241 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
catataataaggattggctc

SEQ ID NO: 95242 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gctcaatattcttttggtgt

SEQ ID NO: 95243 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatattcttttggtgtgcta

SEQ ID NO: 95244 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttttggtgtgctaatcagtg

SEQ ID NO: 95245 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttggtgtgctaatcagtgtt

SEQ ID NO: 95246 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tggtgtgctaatcagtgttg

SEQ ID NO: 95247 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtgtgctaatcagtgttgt

SEQ ID NO: 95248 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgtgctaatcagtgttgtt

SEQ ID NO: 95249 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atcagtgttgttttaaacta

SEQ ID NO: 95250 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttttaaactatgtactttta

SEQ ID NO: 95251 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaactatgtacttttatct

SEQ ID NO: 95252 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaactatgtacttttatctt

SEQ ID NO: 95253 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactatgtacttttatcttt

SEQ ID NO: 95254 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtacttttatcttttttat

SEQ ID NO: 95255 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttatcttttttatctgctag

SEQ ID NO: 95256 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatcttttttatctgctagc

SEQ ID NO: 95257 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atcttttttatctgctagct

SEQ ID NO: 95258 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcttttttatctgctagctg

SEQ ID NO: 95259 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttttatctgctagctgtctt

SEQ ID NO: 95260 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tttatctgctagctgtctta

SEQ ID NO: 95261 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttatctgctagctgtcttac

SEQ ID NO: 95262 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatctgctagctgtcttact

SEQ ID NO: 95263 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atctgctagctgtcttactg

SEQ ID NO: 95264 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tctgctagctgtcttactgt

SEQ ID NO: 95265 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctagctgtcttactgtgact

SEQ ID NO: 95266 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gctgtcttactgtgactttt

SEQ ID NO: 95267 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tcttactgtgacttttattg

SEQ ID NO: 95268 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
actgtgacttttattgctaa

SEQ ID NO: 95269 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgtgacttttattgctaag

SEQ ID NO: 95270 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
tgacttttattgctaagaaa

SEQ ID NO: 95271 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttattgctaagaaaatttgt

SEQ ID NO: 95272 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tattgctaagaaaatttgta

SEQ ID NO: 95273 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgctaagaaaatttgtaa

SEQ ID NO: 95274 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgctaagaaaatttgtaag

SEQ ID NO: 95275 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctaagaaaatttgtaagaat

SEQ ID NO: 95276 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agaaaatttgtaagaattaa

SEQ ID NO: 95277 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtaagaattaaaagtaatga

SEQ ID NO: 95278 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taagaattaaaagtaatgaa

SEQ ID NO: 95279 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaagtaatgaatatcttctt

SEQ ID NO: 95280 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctttgatgatttggcaaata

SEQ ID NO: 95281 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tttgatgatttggcaaatat

SEQ ID NO: 95282 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgatgatttggcaaatattt

SEQ ID NO: 95283 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gatgatttggcaaatattta

SEQ ID NO: 95284 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atgatttggcaaatatttag

SEQ ID NO: 95285 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggcaaatatttagaactttt

SEQ ID NO: 95286 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gcaaatatttagaactttta

SEQ ID NO: 95287 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
agaacttttataaagaatag

SEQ ID NO: 95288 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaacttttataaagaatagg

SEQ ID NO: 95289 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttataaagaatagggagcca

SEQ ID NO: 95290 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tataaagaatagggagccaa

SEQ ID NO: 95291 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaagaatagggagccaaa

SEQ ID NO: 95292 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaagaatagggagccaaat

SEQ ID NO: 95293 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ccattcacaattactacaaa

SEQ ID NO: 95294 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaattactacaaagagaat

SEQ ID NO: 95295 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctacaaagagaataaaatac

SEQ ID NO: 95296 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaagagaataaaataccta

SEQ ID NO: 95297 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggaatccaacttacaaggga

SEQ ID NO: 95298 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaagggatgtgaaggacct

SEQ ID NO: 95299 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caagggatgtgaaggacctc

SEQ ID NO: 95300 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttcaaggagaactacaaacc

SEQ ID NO: 95301 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaggagaactacaaaccac

SEQ ID NO: 95302 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggagaactacaaaccact

SEQ ID NO: 95303 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaaccactgctcagcgaaa

SEQ ID NO: 95304 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctcagcgaaataaaagagga

SEQ ID NO: 95305 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcgaaataaaagaggacac

SEQ ID NO: 95306 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
catgctcatggataggaaga

SEQ ID NO: 95307 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atggataggaagactcaata

SEQ ID NO: 95308 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aatatcatgaaaatggcatt

SEQ ID NO: 95309 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgcccaaggtaatttataa

SEQ ID NO: 95310 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
cccaaggtaatttataaatt

SEQ ID NO: 95311 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ataaattcaatgctatcccc

SEQ ID NO: 95312 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
taaattcaatgctatcccca

SEQ ID NO: 95313 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aatgctatccccatcaagct

SEQ ID NO: 95314 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tccccatcaagctaccactg

SEQ ID NO: 95315 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ccactgactttcttcacaaa

SEQ ID NO: 95316 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
actttcttcacaaaattgga

SEQ ID NO: 95317 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tcttcacaaaattggaaaaa

SEQ ID NO: 95318 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttcacaaaattggaaaaaa

SEQ ID NO: 95319 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttcacaaaattggaaaaaaa

SEQ ID NO: 95320 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cacaaaattggaaaaaaact

SEQ ID NO: 95321 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaaaattggaaaaaaacta

SEQ ID NO: 95322 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaaaaaactactttaaagt

SEQ ID NO: 95323 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctttaaagttcatatggaac

SEQ ID NO: 95324 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
taaagttcatatggaaccaa

SEQ ID NO: 95325 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaagttcatatggaaccaaa

SEQ ID NO: 95326 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagttcatatggaaccaaaa

SEQ ID NO: 95327 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atatggaaccaaaaaagagc

SEQ ID NO: 95328 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catagccaagataatcctaa

SEQ ID NO: 95329 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
agcaaaaagaacaaagctgg

SEQ ID NO: 95330 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaggcgtcacactacctgac

SEQ ID NO: 95331 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctgacttcaaactatacta

SEQ ID NO: 95332 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acttcaaactatactacaag

SEQ ID NO: 95333 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
caaactatactacaaggcta

SEQ ID NO: 95334 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaactatactacaaggctac

SEQ ID NO: 95335 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tactacaaggctacagtaac

SEQ ID NO: 95336 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaggctacagtaaccaaaa

SEQ ID NO: 95337 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagtaaccaaaacagcatgg

SEQ ID NO: 95338 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtaccaaaacagatacatac

SEQ ID NO: 95339 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agaaataacactacacatct

SEQ ID NO: 95340 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cacatctacaaccatctgat

SEQ ID NO: 95341 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaccatctgatccttgaca

SEQ ID NO: 95342 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
atccttgacaaacctcacaa

SEQ ID NO: 95343 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gacaaacctcacaaaaacaa

SEQ ID NO: 95344 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acaaacctcacaaaaacaag

SEQ ID NO: 95345 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
acaaaaacaagcaacgggga

SEQ ID NO: 95346 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccctatttaataaatgatgc

SEQ ID NO: 95347 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctatttaataaatgatgct

SEQ ID NO: 95348 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttaataaatgatgctggga

SEQ ID NO: 95349 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aataaatgatgctgggaaaa

SEQ ID NO: 95350 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ataaatgatgctgggaaaac

SEQ ID NO: 95351 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggaaaactggctagccatat

SEQ ID NO: 95352 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gctagccatatgtagaaagt

SEQ ID NO: 95353 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gccatatgtagaaagttgaa

SEQ ID NO: 95354 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aaactggatcccttccttac

SEQ ID NO: 95355 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gatcccttccttacaccttg

SEQ ID NO: 95356 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ccttacaccttgtacaaaaa

SEQ ID NO: 95357 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cttacaccttgtacaaaaat

SEQ ID NO: 95358 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaccttgtacaaaaattaa

SEQ ID NO: 95359 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caccttgtacaaaaattaac

SEQ ID NO: 95360 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtacaaaaattaactcaaga

SEQ ID NO: 95361 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tacaaaaattaactcaagat

SEQ ID NO: 95362 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
actcaagatggattaaagac

SEQ ID NO: 95363 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagatggattaaagacttaa

SEQ ID NO: 95364 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagacttaaatgtaagacct

SEQ ID NO: 95365 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaatgtaagacctaaaacca

SEQ ID NO: 95366 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aatgtaagacctaaaaccat

SEQ ID NO: 95367 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaccataaaaaccctagaa

SEQ ID NO: 95368 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaagaaactctaggcaatat

SEQ ID NO: 95369 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
taggcaatatcattcaggac

SEQ ID NO: 95370 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggcaatatcattcaggacat

SEQ ID NO: 95371 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aggacataggcatgggcaaa

SEQ ID NO: 95372 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
catgactaaaacaccaaaag

SEQ ID NO: 95373 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgactaaaacaccaaaagc

SEQ ID NO: 95374 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaacaccaaaagcaatggca

SEQ ID NO: 95375 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
attaaactaaagagcttctg

SEQ ID NO: 95376 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aactaaagagcttctgcaaa

SEQ ID NO: 95377 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aagagcttctgcaaagcaaa

SEQ ID NO: 95378 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctgcaaagcaaaagaaacta

SEQ ID NO: 95379 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgcaaagcaaaagaaactat

SEQ ID NO: 95380 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
caaagcaaaagaaactatca

SEQ ID NO: 95381 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tcatcagagtgaacaggcaa

SEQ ID NO: 95382 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cagaatgggagaaaattttt

SEQ ID NO: 95383 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgcaatttatccatctgac

SEQ ID NO: 95384 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcaatttatccatctgaca

SEQ ID NO: 95385 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcaatttatccatctgacaa

SEQ ID NO: 95386 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
caatttatccatctgacaaa

SEQ ID NO: 95387 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atccatctgacaaaagggct

SEQ ID NO: 95388 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccatctgacaaaagggcta

SEQ ID NO: 95389 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
acaaaagggctaatatccag

SEQ ID NO: 95390 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atatccagaatctacaaaga

SEQ ID NO: 95391 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
caaagaacttaaacaaattt

SEQ ID NO: 95392 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaacaaatttacaagaaaaa

SEQ ID NO: 95393 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aacaaatttacaagaaaaaa

SEQ ID NO: 95394 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acaagaaaaaaacaaacaac

SEQ ID NO: 95395 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caagaaaaaaacaaacaact

SEQ ID NO: 95396 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
catcaaaaagtgggcaaagg

SEQ ID NO: 95397 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ctcaaaagaagacatttatg

SEQ ID NO: 95398 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcaaaagaagacatttatgc

SEQ ID NO: 95399 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aaaagaagacatttatgcag

SEQ ID NO: 95400 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgcagccaacagacatatg

SEQ ID NO: 95401 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgcagccaacagacatatga

SEQ ID NO: 95402 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atcatcactggtcatcagag

SEQ ID NO: 95403 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gtcatcagagaaacacaaat

SEQ ID NO: 95404 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
atgccaattagaatggcaat

SEQ ID NO: 95405 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gaatggcaatcactaaaaag

SEQ ID NO: 95406 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaaagtcaggaaacaacaga

SEQ ID NO: 95407 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gagaggatgtggagaaatag

SEQ ID NO: 95408 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttacactgttggtgagagtg

SEQ ID NO: 95409 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacactgttggtgagagtgt

SEQ ID NO: 95410 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acactgttggtgagagtgta

SEQ ID NO: 95411 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cactgttggtgagagtgtaa

SEQ ID NO: 95412 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ttggtgagagtgtaaaatag

SEQ ID NO: 95413 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgagagtgtaaaatagttc

SEQ ID NO: 95414 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaccattgtggaagacagtg

SEQ ID NO: 95415 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tggaagacagtgtgatgatt

SEQ ID NO: 95416 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcaagaatctaaaactaga

SEQ ID NO: 95417 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagaatctaaaactagaaat

SEQ ID NO: 95418 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaactagaaataccatttga

SEQ ID NO: 95419 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaaataccatttgacccagc

SEQ ID NO: 95420 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gacccagcaatctcattact

SEQ ID NO: 95421 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
acccagcaatctcattactg

SEQ ID NO: 95422 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
attactgggtatatactcaa

SEQ ID NO: 95423 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ctgggtatatactcaaggga

SEQ ID NO: 95424 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ggtatatactcaagggattg

SEQ ID NO: 95425 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
aagggattgtaaatcatgct

SEQ ID NO: 95426 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
taaatcatgctactataaag

SEQ ID NO: 95427 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ctataaagacacatgcatat

SEQ ID NO: 95428 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taaagacacatgcatatgta

SEQ ID NO: 95429 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attgcagcactattcacaat

SEQ ID NO: 95430 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttgcagcactattcacaata

SEQ ID NO: 95431 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cagcactattcacaatagca

SEQ ID NO: 95432 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ttcacaatagcaaagacttg

SEQ ID NO: 95433 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acaatagcaaagacttggaa

SEQ ID NO: 95434 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggaaccaacccaaatgtcca

SEQ ID NO: 95435 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gaaccaacccaaatgtccat

SEQ ID NO: 95436 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gataaagaaaatgtggcata

SEQ ID NO: 95437 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgcagccataaaaaaggatg

SEQ ID NO: 95438 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
atgtcctttgtagggacatg

SEQ ID NO: 95439 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgtagggacatgcatgaagc

SEQ ID NO: 95440 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gtagggacatgcatgaagct

SEQ ID NO: 95441 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagggacatgcatgaagctg

SEQ ID NO: 95442 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaccatcattctcagcaa

SEQ ID NO: 95443 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcagcaaaatatcacaagga

SEQ ID NO: 95444 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
agcaaaatatcacaaggacg

SEQ ID NO: 95445 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgcatgttctcactcataag

SEQ ID NO: 95446 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catgttctcactcataagtg

SEQ ID NO: 95447 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcactcataagtgggagttg

SEQ ID NO: 95448 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
actcataagtgggagttgaa

SEQ ID NO: 95449 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ataagtgggagttgaacaat

SEQ ID NO: 95450 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
aacaatgagaacacatggac

SEQ ID NO: 95451 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gggggttgggagctttggga

SEQ ID NO: 95452 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggagctttgggagggattac

SEQ ID NO: 95453 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgggagggattacttaggag

SEQ ID NO: 95454 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gggagggattacttaggaga

SEQ ID NO: 95455 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ggagggattacttaggagaa

SEQ ID NO: 95456 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaggagaaatacctaatg

SEQ ID NO: 95457 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aggagaaatacctaatgtaa

SEQ ID NO: 95458 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ggagaaatacctaatgtaaa

SEQ ID NO: 95459 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atgtaaatgatgagttgatt

SEQ ID NO: 95460 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attggtgcagcaaaccaaca

SEQ ID NO: 95461 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtgcagcaaaccaacatggt

SEQ ID NO: 95462 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tgtaacaaacctgcatgttt

SEQ ID NO: 95463 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
catgttttgcacatgtaccc

SEQ ID NO: 95464 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgcacatgtaccctagaact

SEQ ID NO: 95465 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gcacatgtaccctagaactt

SEQ ID NO: 95466 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
cacatgtaccctagaactta

SEQ ID NO: 95467 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaacttaaagtataataata

SEQ ID NO: 95468 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aaagtataataataaaaaaa

SEQ ID NO: 95469 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagtataataataaaaaaag

SEQ ID NO: 95470 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
catacaataaccaaaattgt

SEQ ID NO: 95471 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tattaattttatattcattt

SEQ ID NO: 95472 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attttatattcattttaata

SEQ ID NO: 95473 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tatattcattttaatatacc

SEQ ID NO: 95474 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atattcattttaatatacca

SEQ ID NO: 95475 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tattcattttaatataccat

SEQ ID NO: 95476 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
attttaatataccattattc

SEQ ID NO: 95477 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taatataccattattccttt

SEQ ID NO: 95478 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aatataccattattccttta

SEQ ID NO: 95479 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
atataccattattcctttac

SEQ ID NO: 95480 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttcctttacataaaaaatga

SEQ ID NO: 95481 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctttacataaaaaatgaata

SEQ ID NO: 95482 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tacataaaaaatgaatataa

SEQ ID NO: 95483 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acataaaaaatgaatataaa

SEQ ID NO: 95484 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cataaaaaatgaatataaac

SEQ ID NO: 95485 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aaatgataatatacatttct

SEQ ID NO: 95486 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctatatctctatttcaagaa

SEQ ID NO: 95487 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tatatctctatttcaagaaa

SEQ ID NO: 95488 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tatctctatttcaagaaact

SEQ ID NO: 95489 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tatttcaagaaactctttga

SEQ ID NO: 95490 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
tttcaagaaactctttgact

SEQ ID NO: 95491 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caagaaactctttgactacc

SEQ ID NO: 95492 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aagaaactctttgactacct

SEQ ID NO: 95493 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tttgactacctttttaattc

SEQ ID NO: 95494 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgactacctttttaattcta

SEQ ID NO: 95495 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactacctttttaattctaa

SEQ ID NO: 95496 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actacctttttaattctaaa

SEQ ID NO: 95497 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cctttttaattctaaataaa

SEQ ID NO: 95498 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaattctaaataaaggat

SEQ ID NO: 95499 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaattctaaataaaggatt

SEQ ID NO: 95500 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taattctaaataaaggattt

SEQ ID NO: 95501 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aattctaaataaaggatttc

SEQ ID NO: 95502 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
attctaaataaaggatttca

SEQ ID NO: 95503 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taaataaaggatttcaacat

SEQ ID NO: 95504 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aataaaggatttcaacataa

SEQ ID NO: 95505 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caacataaacactttattgg

SEQ ID NO: 95506 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacataaacactttattgga

SEQ ID NO: 95507 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattggatgtcaacattatc

SEQ ID NO: 95508 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attggatgtcaacattatcc

SEQ ID NO: 95509 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttggatgtcaacattatcct

SEQ ID NO: 95510 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatgtcaacattatccttga

SEQ ID NO: 95511 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tccttgatagatttctaggt

SEQ ID NO: 95512 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gatagatttctaggtactga

SEQ ID NO: 95513 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
atagatttctaggtactgag

SEQ ID NO: 95514 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ctaggtactgaggaagttat

SEQ ID NO: 95515 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
taggtactgaggaagttatc

SEQ ID NO: 95516 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
ggtactgaggaagttatcaa

SEQ ID NO: 95517 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aggaagttatcaattatcat

SEQ ID NO: 95518 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcaattatcatacccaaact

SEQ ID NO: 95519 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tcatacccaaactgaaggac

SEQ ID NO: 95520 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
aaggactttccaattgatta

SEQ ID NO: 95521 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tccaattgattacataaaag

SEQ ID NO: 95522 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccaattgattacataaaaga

SEQ ID NO: 95523 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
caattgattacataaaagaa

SEQ ID NO: 95524 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
attacataaaagaaaatata

SEQ ID NO: 95525 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cataaaagaaaatataactt

SEQ ID NO: 95526 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ttaaaattcaacagtaaata

SEQ ID NO: 95527 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taaaattcaacagtaaataa

SEQ ID NO: 95528 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aaaattcaacagtaaataac

SEQ ID NO: 95529 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aaattcaacagtaaataaca

SEQ ID NO: 95530 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aacagtaaataacataacat

SEQ ID NO: 95531 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatgaggtttttgactggaa

SEQ ID NO: 95532 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttgactggaaaagcctaaat

SEQ ID NO: 95533 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tgactggaaaagcctaaatc

SEQ ID NO: 95534 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gactggaaaagcctaaatct

SEQ ID NO: 95535 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
actggaaaagcctaaatctt

SEQ ID NO: 95536 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaaaagcctaaatcttacaa

SEQ ID NO: 95537 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
aatcttacaaaggggggcta

SEQ ID NO: 95538 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
acaaaggggggctagaagct

SEQ ID NO: 95539 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
caaaggggggctagaagctt

SEQ ID NO: 95540 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
gaagcttcagttgctccctt

SEQ ID NO: 95541 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cagttgctccctttgttctc

SEQ ID NO: 95542 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agttgctccctttgttctct

SEQ ID NO: 95543 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ctccctttgttctctgctaa

SEQ ID NO: 95544 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
cctttgttctctgctaattt

SEQ ID NO: 95545 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tgttctctgctaatttctta

SEQ ID NO: 95546 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
gttctctgctaatttcttaa

SEQ ID NO: 95547 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
ttctctgctaatttcttaag

SEQ ID NO: 95548 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tctgctaatttcttaagtta

SEQ ID NO: 95549 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
tgctaatttcttaagttagc

SEQ ID NO: 95550 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
ctaatttcttaagttagctg

SEQ ID NO: 95551 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
atttcttaagttagctgtaa

SEQ ID NO: 95552 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cttaagttagctgtaagttt

SEQ ID NO: 95553 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ttaagttagctgtaagtttt

SEQ ID NO: 95554 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aagttagctgtaagttttac

SEQ ID NO: 95555 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agttagctgtaagttttaca

SEQ ID NO: 95556 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gctgtaagttttacagattt

SEQ ID NO: 95557 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
taagttttacagatttatgt

SEQ ID NO: 95558 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tacagatttatgtatattct

SEQ ID NO: 95559 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acagatttatgtatattcta

SEQ ID NO: 95560 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cagatttatgtatattctac

SEQ ID NO: 95561 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atgtatattctacattagtc

SEQ ID NO: 95562 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tgtatattctacattagtct

SEQ ID NO: 95563 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tacattagtctataatttca

SEQ ID NO: 95564 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
cattagtctataatttcacc

SEQ ID NO: 95565 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtctataatttcaccttttt

SEQ ID NO: 95566 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTA
taatttcacctttttaagtc

SEQ ID NO: 95567 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
cacctttttaagtcacagca

SEQ ID NO: 95568 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
acctttttaagtcacagcat

SEQ ID NO: 95569 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tttaagtcacagcataaatt

SEQ ID NO: 95570 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ttaagtcacagcataaatta

SEQ ID NO: 95571 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
taagtcacagcataaattag

SEQ ID NO: 95572 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
aagtcacagcataaattagt

SEQ ID NO: 95573 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agtcacagcataaattagta

SEQ ID NO: 95574 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
gtataatccatataattaag

SEQ ID NO: 95575 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
agaatttattttcaaggatt

SEQ ID NO: 95576 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attttcaaggatttatagtt

SEQ ID NO: 95577 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttttcaaggatttatagttc

SEQ ID NO: 95578 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
tcaaggatttatagttctga

SEQ ID NO: 95579 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
caaggatttatagttctgag

SEQ ID NO: 95580 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
aaggatttatagttctgaga

SEQ ID NO: 95581 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
atagttctgagatcattact

SEQ ID NO: 95582 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tagttctgagatcattactt

SEQ ID NO: 95583 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tgagatcattacttaacttg

SEQ ID NO: 95584 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
agatcattacttaacttgta

SEQ ID NO: 95585 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttaacttgtagggtgctgg

SEQ ID NO: 95586 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
aacttgtagggtgctggaat

SEQ ID NO: 95587 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
acttgtagggtgctggaatt

SEQ ID NO: 95588 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
gtagggtgctggaattaaag

SEQ ID NO: 95589 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
tagggtgctggaattaaaga

SEQ ID NO: 95590 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gaattaaagatgacctggtt

SEQ ID NO: 95591 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
aagatgacctggttatggtt

SEQ ID NO: 95592 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTG
gttatggtttccctttattc

SEQ ID NO: 95593 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tggtttccctttattctctt

SEQ ID NO: 95594 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ccctttattctcttggattt

SEQ ID NO: 95595 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
cctttattctcttggatttg

SEQ ID NO: 95596 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
tattctcttggatttggtaa

SEQ ID NO: 95597 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
attctcttggatttggtaat

SEQ ID NO: 95598 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
ttctcttggatttggtaata

SEQ ID NO: 95599 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
tcttggatttggtaatattc

SEQ ID NO: 95600 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttggatttggtaatattcag

SEQ ID NO: 95601 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
ggatttggtaatattcagct

SEQ ID NO: 95602 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gatttggtaatattcagctt

SEQ ID NO: 95603 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
ggtaatattcagcttcctct

SEQ ID NO: 95604 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTG
gtaatattcagcttcctctt

SEQ ID NO: 95605 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
agcttcctcttatttactta

SEQ ID NO: 95606 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
cctcttatttacttattttt

SEQ ID NO: 95607 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTC
ctcttatttacttatttttt

SEQ ID NO: 95608 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTC
ttatttacttatttttttaa

SEQ ID NO: 95609 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttacttatttttttaatt

SEQ ID NO: 95610 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttacttatttttttaattg

SEQ ID NO: 95611 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTT
acttatttttttaattgttt

SEQ ID NO: 95612 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
cttatttttttaattgtttg

SEQ ID NO: 95613 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: CTT
atttttttaattgtttgcta

SEQ ID NO: 95614 - DNA, 20 bp, synthetic construct
  source 1..20: mol_type = other DNA; note = Description of Artificial Sequence: Synthetic oligonucleotide; note = Target: SCN9A; (+) strand; PAM type: YTN; PAM sequence: TTA
tttttttaattgtttgctat
